(12) United States Patent
Lai-Goldman et al.

(10) Patent No.: US 12,006,554 B2
(45) Date of Patent: Jun. 11, 2024

(54) METHODS FOR SUBTYPING OF HEAD AND NECK SQUAMOUS CELL CARCINOMA

(71) Applicants: GeneCentric Therapeutics, Inc., Research Triangle Park, NC (US); The University of North Carolina at Chapel Hill, Chapel Hill, NC (US)

(72) Inventors: Myla Lai-Goldman, Durham, NC (US); Hawazin Faruki, Durham, NC (US); Greg Mayhew, Durham, NC (US); Charles Perou, Carrboro, NC (US); David Neil Hayes, Chapel Hill, NC (US)

(73) Assignees: GeneCentric Therapeutics, Inc., Durham, NC (US); The University of North Carolina at Chapel Hill, Chapel Hill, NC (US)

( * ) Notice: Subject to any disclaimer, the term of this patent is extended or adjusted under 35 U.S.C. 154(b) by 174 days.

(21) Appl. No.: 16/637,017

(22) PCT Filed: Aug. 7, 2018

(86) PCT No.: PCT/US2018/045522
§ 371 (c)(1),
(2) Date: Feb. 6, 2020

(87) PCT Pub. No.: WO2019/032525
PCT Pub. Date: Feb. 14, 2019

(65) Prior Publication Data
US 2020/0216908 A1 Jul. 9, 2020

Related U.S. Application Data

(60) Provisional application No. 62/629,934, filed on Feb. 13, 2018, provisional application No. 62/608,218, (Continued)

(51) Int. Cl.
*C12Q 1/6886* (2018.01)
*C12Q 1/686* (2018.01)

(52) U.S. Cl.
CPC .......... *C12Q 1/6886* (2013.01); *C12Q 1/686* (2013.01); *C12Q 2561/113* (2013.01);
(Continued)

(58) Field of Classification Search
CPC .......... C12Q 1/6886; C12Q 2600/158; C12Q 2600/106; C12Q 2600/112
See application file for complete search history.

(56) References Cited

U.S. PATENT DOCUMENTS 4,683,202 A 7/1987 Mullis
4,843,155 A 6/1989 Chomczynski
(Continued)

FOREIGN PATENT DOCUMENTS

WO WO 2017/083640 A1 5/2017

OTHER PUBLICATIONS

Jung, A.C. et al. Oncotarget 6(39):41884-41901. Oct. 2015. (Year: 2015).*
(Continued)

*Primary Examiner* — Diana B Johannsen
(74) *Attorney, Agent, or Firm* — COOLEY LLP

(57) ABSTRACT

Methods and compositions are provided for determining a subtype of head and neck squamous cell carcinoma (HNSCC) of an individual by detecting the expression level of at least one classifier biomarker selected from a group of gene signatures for HNSCC. Also provided herein are methods and compositions for determining the response of an individual with a HNSCC subtype to a therapy such as immunotherapy.

15 Claims, 25 Drawing Sheets

Specification includes a Sequence Listing.

Related U.S. Application Data filed on Dec. 20, 2017, provisional application No. 62/541,960, filed on Aug. 7, 2017.

(52) U.S. Cl.
CPC .. *C12Q 2600/106* (2013.01); *C12Q 2600/112* (2013.01); *C12Q 2600/158* (2013.01); *G01N 2800/52* (2013.01); *G01N 2800/56* (2013.01); *G01N 2800/60* (2013.01)

(56) References Cited

U.S. PATENT DOCUMENTS

| | | | |
|---|---|---|---|
| 5,384,261 | A | 1/1995 | Winkler et al. |
| 5,445,934 | A | 8/1995 | Fodor et al. |
| 5,677,195 | A | 10/1997 | Winkler et al. |
| 5,708,153 | A | 1/1998 | Dower et al. |
| 5,744,305 | A | 4/1998 | Fodor et al. |
| 5,770,358 | A | 6/1998 | Dower et al. |
| 5,770,722 | A | 6/1998 | Lockhart et al. |
| 5,789,162 | A | 8/1998 | Dower et al. |
| 5,800,992 | A | 9/1998 | Fodor et al. |
| 5,854,033 | A | 12/1998 | Lizardi |
| 5,856,174 | A | 1/1999 | Lipshutz et al. |
| 5,874,219 | A | 2/1999 | Rava et al. |
| 5,922,591 | A | 7/1999 | Anderson et al. |
| 6,020,135 | A | 2/2000 | Levine et al. |
| 6,033,860 | A | 3/2000 | Lockhart et al. |
| 6,040,138 | A | 3/2000 | Lockhart et al. |
| 6,040,193 | A | 3/2000 | Winkler et al. |
| 6,344,316 | B1 | 2/2002 | Lockhart et al. |
| 6,524,581 | B1 | 2/2003 | Adamis |
| 7,473,767 | B2 | 1/2009 | Dimitrov |
| 8,492,094 | B2 | 7/2013 | Dimitrov et al. |
| 2009/0171872 | A1 | 7/2009 | Roder et al. |
| 2015/0293098 | A1 | 10/2015 | Hayes et al. |
| 2016/0046616 | A1 | 2/2016 | Biswal et al. |
| 2021/0074431 | A1 | 3/2021 | Lai-Goldman et al. |

OTHER PUBLICATIONS

International Search Report and Written Opinion issued by the International Searching Authority for Application No. PCT/US2018/045522, dated Dec. 7, 2018, 21 pages.

International Search Report and Written Opinion issued by the International Searching Authority for Application No. PCT/US2018/048862, dated Jan. 2, 2019, 11 pages.

Aminuddin et al., Promising Druggable Target in Head and Neck Squamous Cell Carcinoma: Wnt Signaling. Frontiers in Pharmacology 7(244):1-13 (2016).

Ang et al., Human papillomavirus and survival of patients with oropharyngeal cancer. N Engl J Med. 363(1):24-35 (2010).

Barany, "Cloning, overexpression and nucleotide sequence of a thermostable DNA ligase-encoding gene," Proc. Natl. Acad. Sci. USA 88:189-193 (1991).

Bibikova et al., "Quantitative gene expression profiling in formalin-fixed, paraffin-embedded tissues using universal bead arrays," Am J. Pathol 165:1799-1807 (2004).

Bindea et al., "Spatiotemporal dynamics of intratumoral immune cells reveal the immune landscape in human cancer," Immunity 39(4)782-795 (2013).

Bishop et al., "Detection of transcriptionally active high-risk HPV in patients with head and neck squamous cell carcinoma as visualized by a novel E6/E7 mRNA in situ hybridization method," Am J Surg Pathol. 36(12):1874-1882 (2012).

Bolstad et al., "A comparison of normalization methods for high density oligonucleotide array data based on variance and bias," Bioinformatics 19(2):185-193 (2003).

Brenner et al., "Gene expression analysis by massively parallel signature sequencing (MPSS) on microbead arrays," Nat. Biotech. 18:630-634 (2000).

Broomhead DS, Jones R, King GP., "Comment on Singular-value decomposition and embedding dimension," Phys Rev A Gen Phys. Jun. 15;37(12):5004-5005 (1988).

Chow, Antitumor Activity of Pembrolizumab in Biomarker—Unselected Patients With Recurrent and/or Metastatic Head and Neck Squamous Cell Carcinoma: Results From the Phase Ib KEYNOTE-012 Expansion Cohort. Journal of Clinical Oncology 34(32):3838-3845 (2016).

Chung CH, et al., "Molecular classification of head and neck squanlous cell carcinomas using patterns ofgene expression," Cancer cell. 5(5):489-500 (2004).

Chute et al., "Cytology of Head and Neck Squamous Cell Carcinoma Variants," Diagnostic Cytopathology 38(1):65-80 (2009).

Clark et al., "Suppression of nonspecific binding of avidin-biotin complex (ABC) to proteins electroblotted to nitrocellulose paper," J Histochem Cytochem 34:1509-1512 (1986).

Cronin et al., "Measurement of gene expression in archival paraffin-embedded tissues: development and performance of a 92-gene reverse transcriptase-polymerase chain reaction assay," Am. J Pathol. 164(1):35-42 (2004).

Dabney, "ClaNC: Point-and-click software for classifying microarrays to nearest centroids," Bioinformatics. 22: 122-123 (2006).

Dabney, "Classification of microarrays to nearest centroids," Bioinformatics 21(22):4148-4154 (2005).

Fakhry et al., "Improved survival of patients with human papillomavirus positive head and neck squamous cell carcinoma in a prospective clinical trial," J Natl Cancer Inst. 100(4):261-269 (2008).

Fan et al., "A Versatile Assay for High-Throughput Gene Expression Profiling on Universal Array Matrices," Genome Res. 14:878-885 (2004).

Fishel and Kaufman et al., "Meta-analysis of gene expression data: a predictor-based approach," Bioinformatics 23(13): 1599-606 (2007).

Fox et al., "Formaldehyde Fixation," J Histochem Cytochem 33:845-853 (1985).

Friedman et al., "Regularization Paths for Generalized Linear Models via Coordinate Descent," Journal of statistical software 33(1): 1-22 (2010).

Geiss et al., "Direct multiplexed measurement of gene expression with color-coded probe pairs," Nat. Biotechnol. 26:317-325 (2008).

Guatelli et al., "Isothermal, in vitro amplification of nucleic acids by a multienzyme reaction modeled after retroviral replication," Proc Natl Acad Sci U S A. 87(5):1874-1878 (1990).

Guo et al. "Cervista HPV assays for fine-needle aspiration specimens are a valid option for human papillomavirus testing in patients with oropharyngeal carcinoma," Cancer Cytopathology 122: 96-103 (2014).

Harari, "Epidermal growth factor receptor inhibition strategies in oncology," Endocrine-Related Cancer. 11(4):689-708 (2004).

Irizarry et al., "Exploration, normalization, and summaries of high density oligonucleotide array probe level data," Biostatistics April 4(2): 249-64 (2003).

Jarboe et al., "Detection of Human Papillomavirus Using Hybrid Capture 2 in Oral Brushings From Patients With Oropharyngeal Squamous Cell Carcinoma," American Journal of Clinical Pathology, 135(5):766-769 (2011).

Kalu et al., "Genomic characterization of human papillomavirus-positive and -negative human squamous cell cancer cell lines," Oncotarget. 8(49):86369-86383 (2017).

Keck MK, et al. "Integrative Analysis of Head and Neck Cancer Identifies Two Biologically Distinct HPV and Three Non-HPV Subtypes," Clin Cancer Res. 21:870-881 (2015).

Kerr et al., "Performance of a branch chain RNA in situ hybridization assay for the detection of high-risk human papillomavirus in head and neck squamous cell carcinoma," Am J Surg Pathol. 39(12):1643-1652 (2016).

Kraus et al., Presence of E6 and E7 mRNA from Human Papillomavirus Types 16, 18, 31, 33, and 45 in the Majority of Cervical Carcinomas. Journal of Clinical Microbiology 44(4):1310-1317 (2006).

Kwoh et al., "Transcription-based amplification system and detection of amplified human immunodeficiency virus type 1 with a

(56) References Cited

OTHER PUBLICATIONS bead-based sandwich hybridization format (TI RNA polymerase/in vitro nucleic acid amplification)," Proc. Natl. Acad. Sci. USA, 86:1173-1177 (1989).

Landegren et al., "A ligase-mediated gene detection technique," Science, 241(4869):1077-1080 (1988).

Lawrence MS, et al. "Comprehensive genomic characterization of head and neck squamous cell carcinomas," Nature 517: 576-582 (2015).

Levi et al., "A Comparison of the Roche Cobas HPV Test With the Hybrid Capture 2 Test for the Detection of High-Risk Human Papillomavirus Genotypes," Archives of Pathology & Laboratory Medicine 140(2):153-157 (2016).

Lewis Jr et al., "Human Papillomavirus Testing in Head and Neck Carcinomas: Guideline From the College of American Pathologists," Archives of Pathology & Laboratory Medicine 142(5):559-597 (2018).

Li and Dewey, "RSEM: accurate transcript quantification from RNA-Seq data with or without a reference genome," BMC Bioinformatics 12:323, 16 pages (2011).

Max et al., "Performance of Aptima E6/E7 mRNA HPV assays on fine needle aspirates from cervical lymph nodes of patients with metastatic oropharyngeal squamous cell carcinoma," Otorhinolaryngol Head Neck Surg 2(5):1-7 (2017).

McGhee and von Hippel, "Formaldehyde as a probe of DNA structure. II. Reaction with endocyclic imino groups of DNA bases," Biochemistry 14:1281-1296 (1975).

Mehra et al., "Efficacy and safety of pembrolizumab in recurrenVmetastalic head and neck squamous cell carcinoma (RIM HNSCC): Pooled analyses after long-term follow-up in KEYNOTE-012," Br J Cancer 119(2): 153-159 (2018).

Meyer D., "Support vector machines: the interface to libsvm in package e1071," 2014, 8 pages (dated Jul. 23, 2018).

Moody CA. Laimins LA. Human papillomavirus oncoproteins: pathways to transformation. Nat Rev Cancer 10(8):550-560 (2010).

Mullins et al., "Agreement in breast cancer classification between microarray and quantitative reverse transcription PCR from fresh-frozen and formalin-fixed, paraffin-embedded tissues," Clin Chem. 53(7):1273-1279 (2007).

Munger K. et al., "Mechanisms of human papillomavirus-induced oncogenesis." J Viral. 78(21): 11451-11460 (2004).

Paolillo et al., "Small molecule integrin antagonists in cancer therapy," Mini Rev Med Chem 12:1439-1446 (2009).

Parfenov et al., "Characterization of HPV and Host Genome Interactions in Primary Head and Neck Cancers," Proceedings of the National Academy of Sciences of the United States of America. 111(43):15544-15549 (2014).

Parzen, "On Estimation of a Probability Density Function and Mode," Stanford University, 1065-1076 (1962).

Quinlan, "Induction of Decision Trees," Machine Learning 1(1):81-106 (1986).

Robin et al., "pROC: an open source package for R and S+ to analyze and compare ROC curves," BMC bioinformatic 12:77 (2011), 8 pages.

Rouskin et al., "Genome-wide probing of RNA structure reveals active unfolding of mRNA structures in vivo," Nature 505, pp. 701-705 (2014).

Rupp G and Locker J., University of Pittsburgh School of Medicine, "Purification and analysis of RNA from paraffin embedded tissues," BioTechniques 6(1):56-60 (1988).

Siegel et al., "Cancer Statistics," CA Cancer J Clin. 2015, 65: 5-29 (2015).

Smyth, G. K., Limma: linear models for microarray data. in: Bioinformatics and Computational Biology Solutions using Rand Bioconductor, R. Gentleman, V. Carey, S. Dudoit, R.Irizarry, W. Huber (eds.), Springer, New York, pp. 397-420 (2005).

Smyth, G. K., "Linear Models and Empirical Bayes Methods for Assessing Differential Expression in Microarray Experiments," Stat. Appi. Genet. Mol. Biol. 3: Article 3 (2004), 28 pages.

Suykens JAK, Vandewalle J., "Least Squares Support Vector Machine Classifiers," Neural Processing Letters 9(3): 293-300 (1999).

Szumilas, "Explaining odds ratios," J. Can. Acad. Child Adolesc. Psychiatry 19(3): 227-229 (2010).

Tibshirani et al., "Diagnosis of multiple cancer types by shrunken centroids of gene expression," Proc. Natl. Acad. Sci. USA 99(10):6576-6572 (2002).

Trapnell et al., "TopHat: discovering splice junctions with RNA-Seq," Bioinformatics 25(9):1105-11 (2009).

Ukpo et al., High-risk human papillomavirus E6/E7 mRNA detection by a novel in situ hybridization assay strongly correlates with p16 expression and patient outcomes in oropharyngeal squamous cell carcinoma. Am J Surg Pathol. 35(9):1343-1350 (2011).

Velculescu et al., "Characterization of the yeast transcriptome," Cell 88(2):243-251 (1997).

Velculescu et al., "Serial analysis of gene expression," Science 270(5235):484-487 (1995).

Venuti A, Paolini F. HPV Detection Methods in Head and Neck Cancer. Head and Neck Pathology 6(Suppl 1):63-74 (2012).

Walter et al., "Molecular Subtypes in Head and Neck Cancer Exhibit Distinct Patterns of Chromosomal Gain and Loss of Canonical Cancer Genes," PLoS One, 8(2):e56823, 1-11 (2013).

Wichman et al., "The role of HPV RNA transcription, immune response-related gene expression and disruptive TP53 mutations in diagnostic and prognostic profiling of head and neck cancer," Intl Jrnl Cancer 137: 2846-2857 (2015).

Wilkerson et al., "ConsensusCiusterPlus: a class discovery tool with confidence assessments and item tracking," Bioinformatics 26(12):1572-1573 (2010).

Wold et al., "Genome expression and mRNA maturation at late stages of productive adenovirus type 2 infection," J Virol. 20(2):465-77 (1976).

Wu and Wallace, "The ligation amplification reaction (LAR)—amplification of specific DNA sequences using sequential rounds of template dependent ligation," Genomics, 4(4):560-569 (1989).

Zevallos et al., "Gene Expression Subtype Analysis of Laryngeal and Oral Cavity Squamous Cell Carcinoma reveals Novel Molecular Markers of Nodal Metastasis and Survival," Laryngoscope 129(1):154-161 (2019).

Partial Supplementary European Search Report issued by the European Patent Office for Application No. 18843577.0, dated Apr. 8, 2021, 14 pages.

Extended European Search Report issued by the European Patent Office for Application No. 18843577.0, dated Jul. 9, 2021, 11 pages.

Puram et al., "Single-Cell Transcriptomic Analysis of Primary and Metastatic Tumor Ecosystems in Head and Neck Cancer," CELL 171(7):1611-1624 (2017).

Warta et al., "Association of Drug Transporter Expression with Mortality and Progression-Free Survival in State IV Head and Neck Squamous Cell Carcinoma," PLOS ONE 9(10): e108908, pp. 1-8 (2014).

Toustrup, K., et al., "Development of a Hypoxia Gene Expression Classifier with Predictive Impact for Hypoxic Modification of Radiotherapy in Head and Neck Cancer," Cancer Research, 2011, vol. 71 (17), pp. 5923-5931.

* cited by examiner

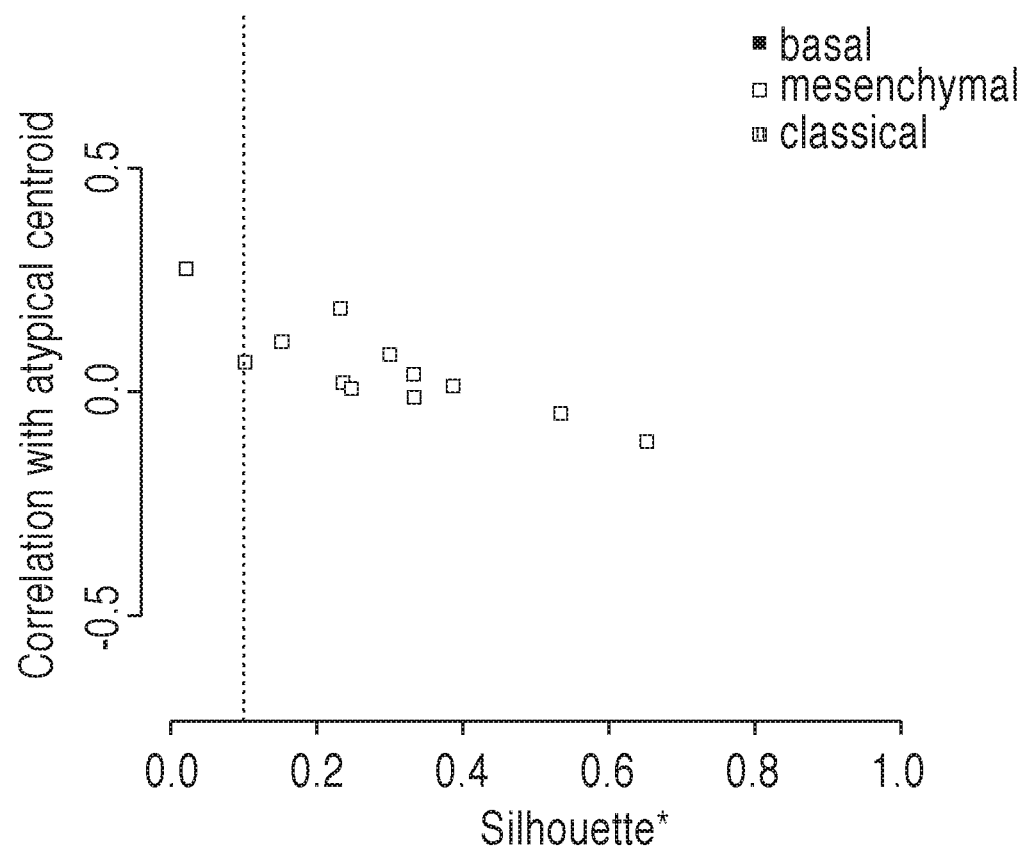

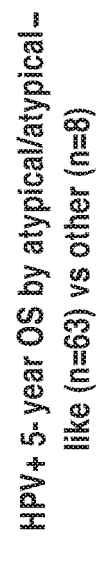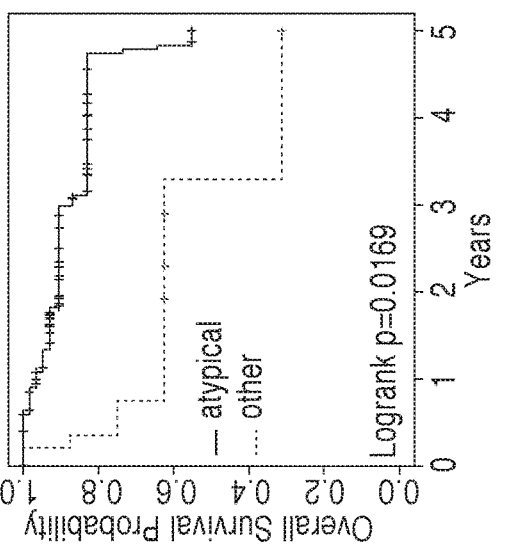
FIG. 4A
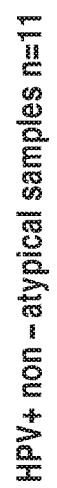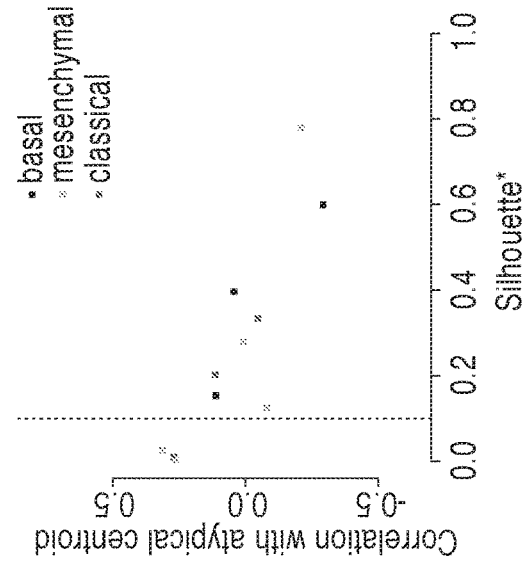
FIG. 4B
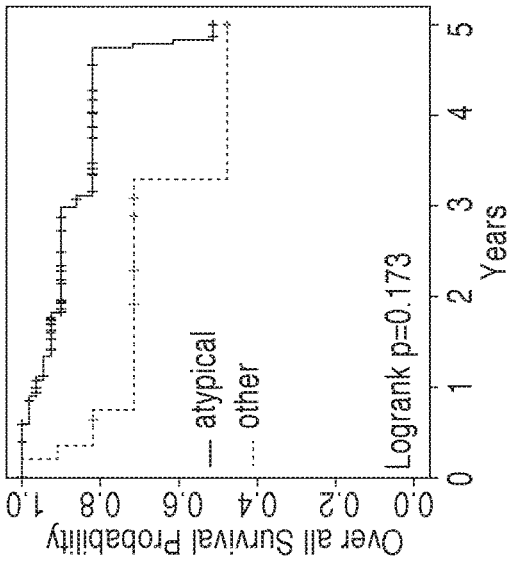
FIG. 4C

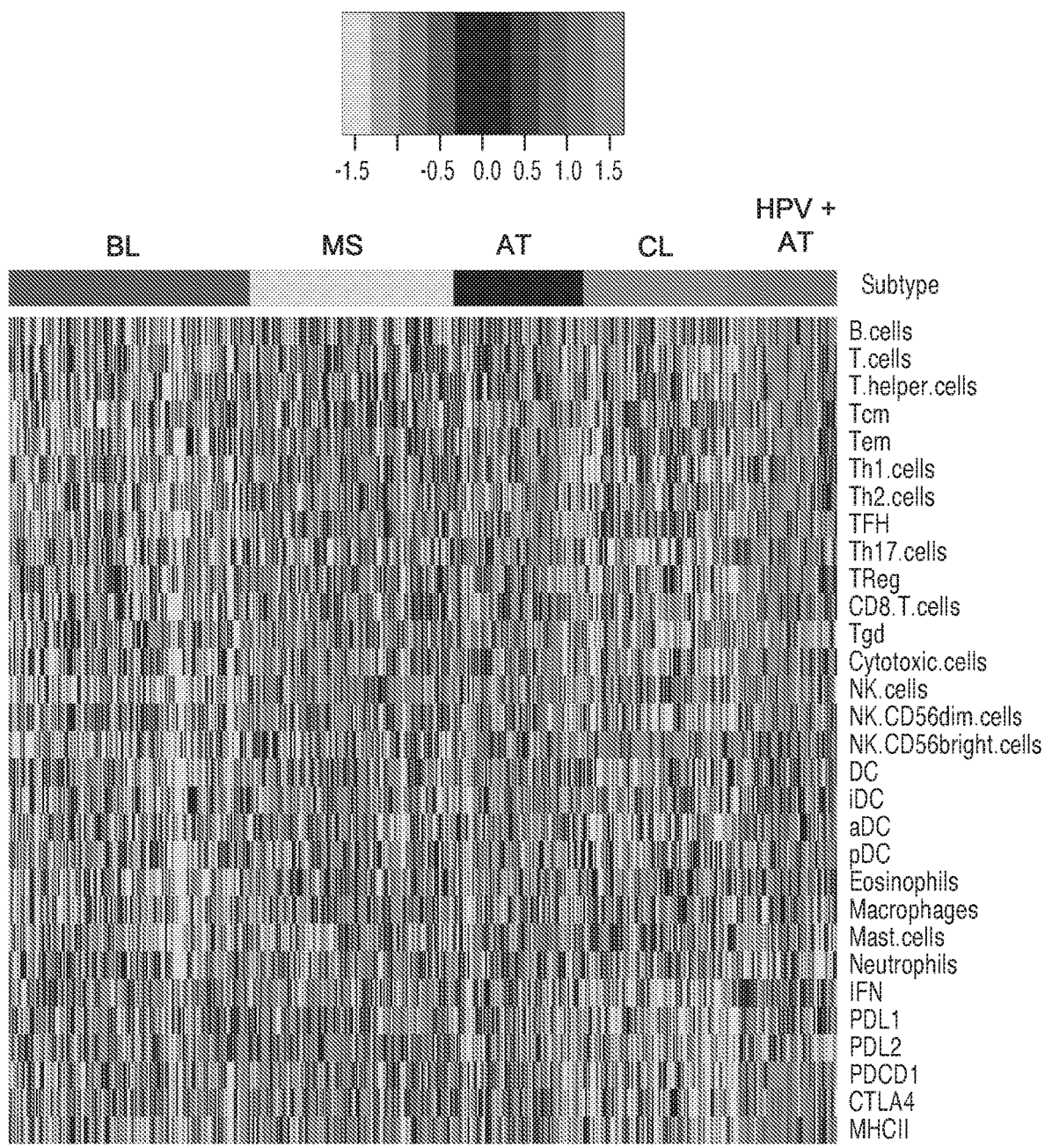

FIG. 6 (Contd)
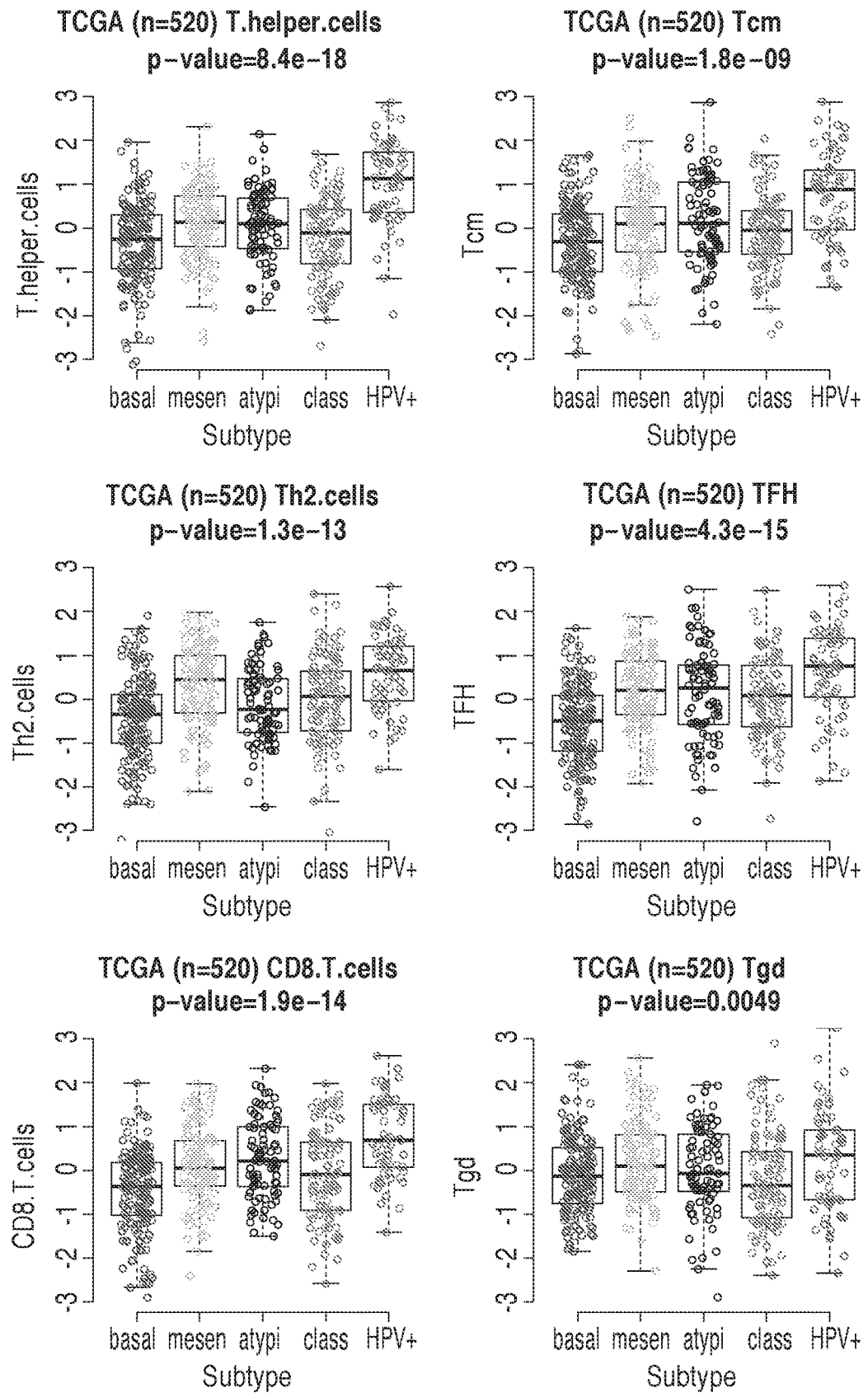

FIG. 6 (Contd)
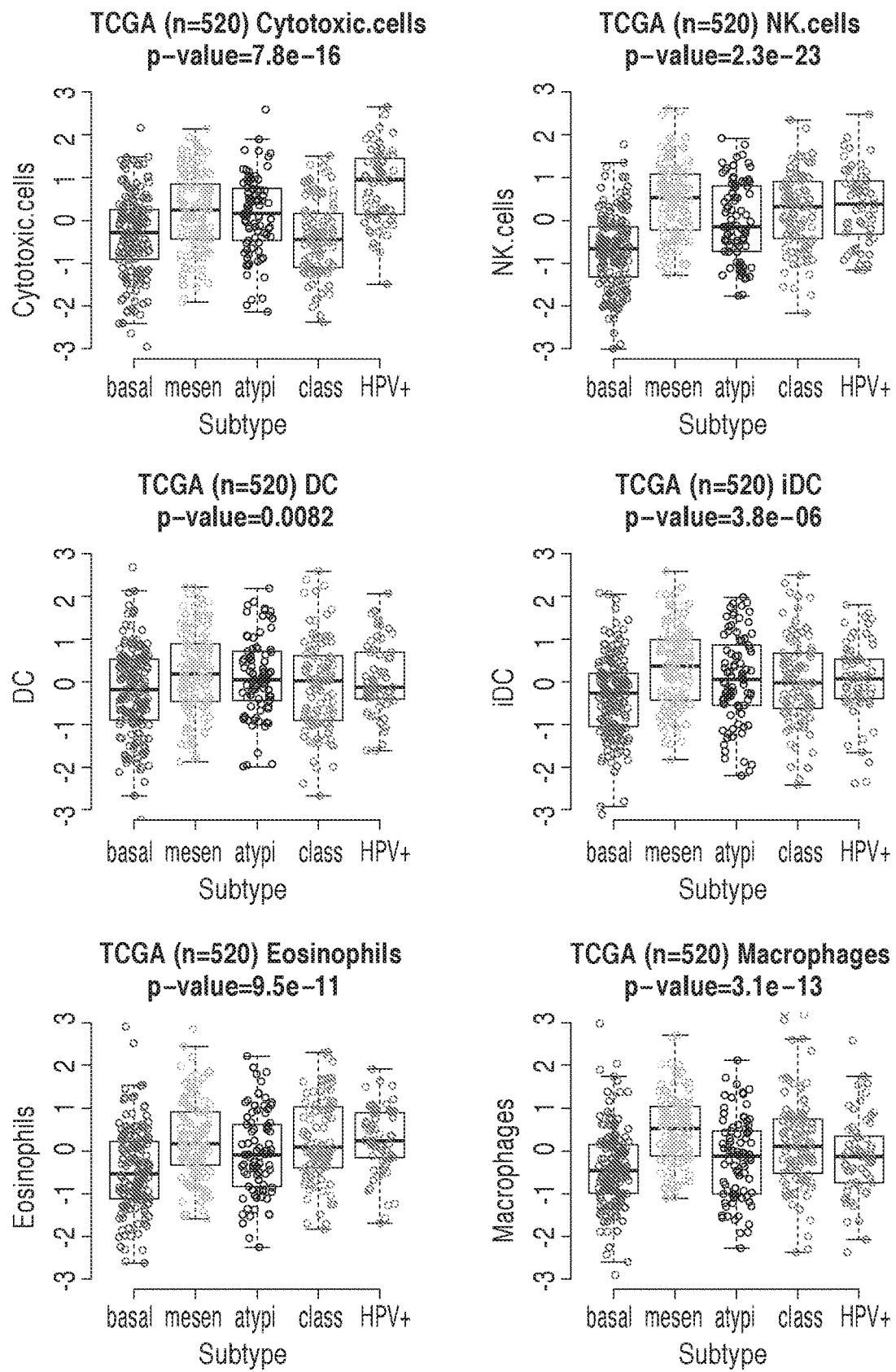

FIG. 6 (Contd)
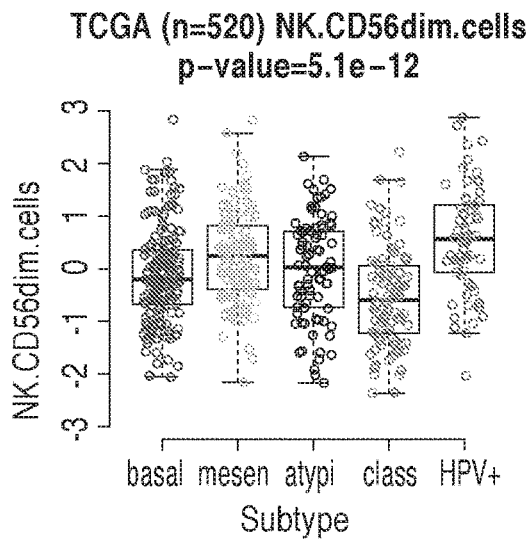
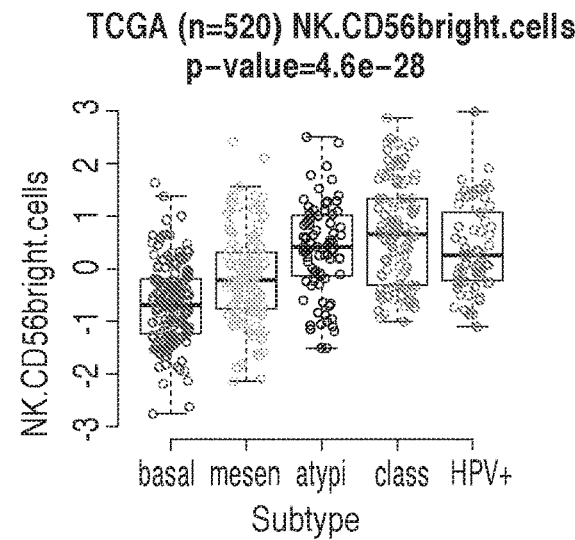
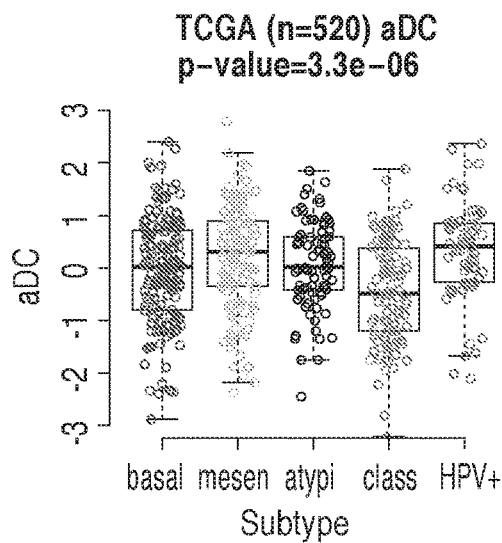
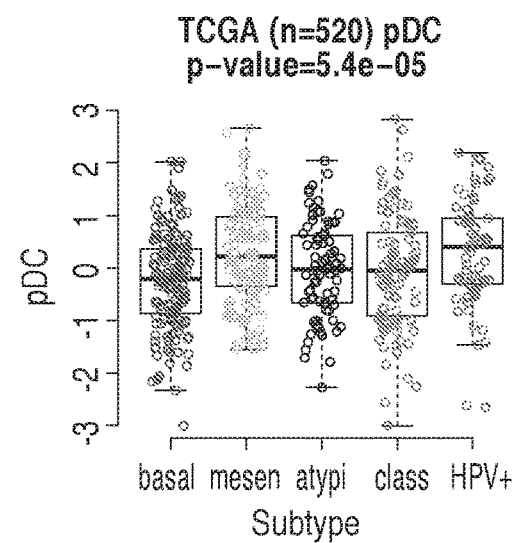
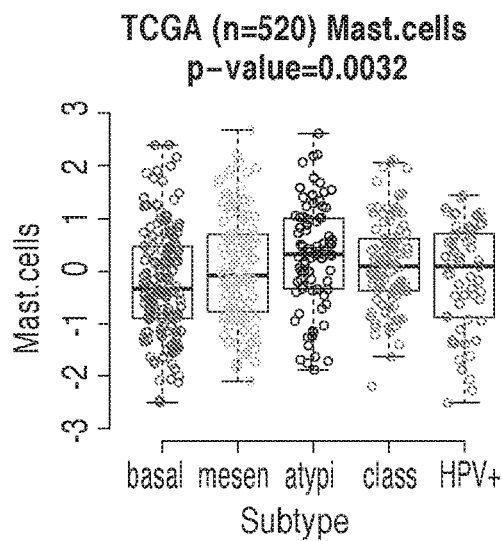
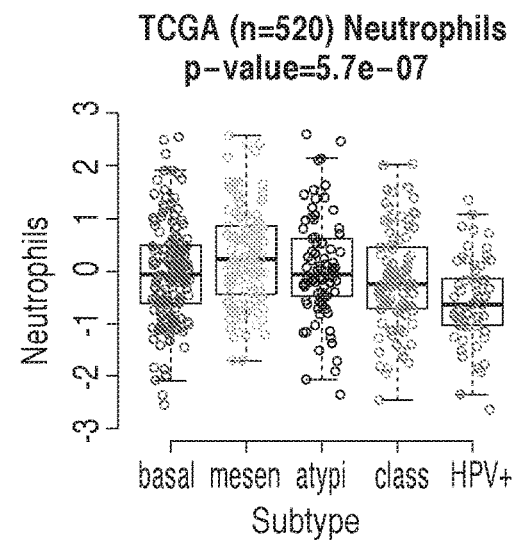

FIG. 6 (Contd)
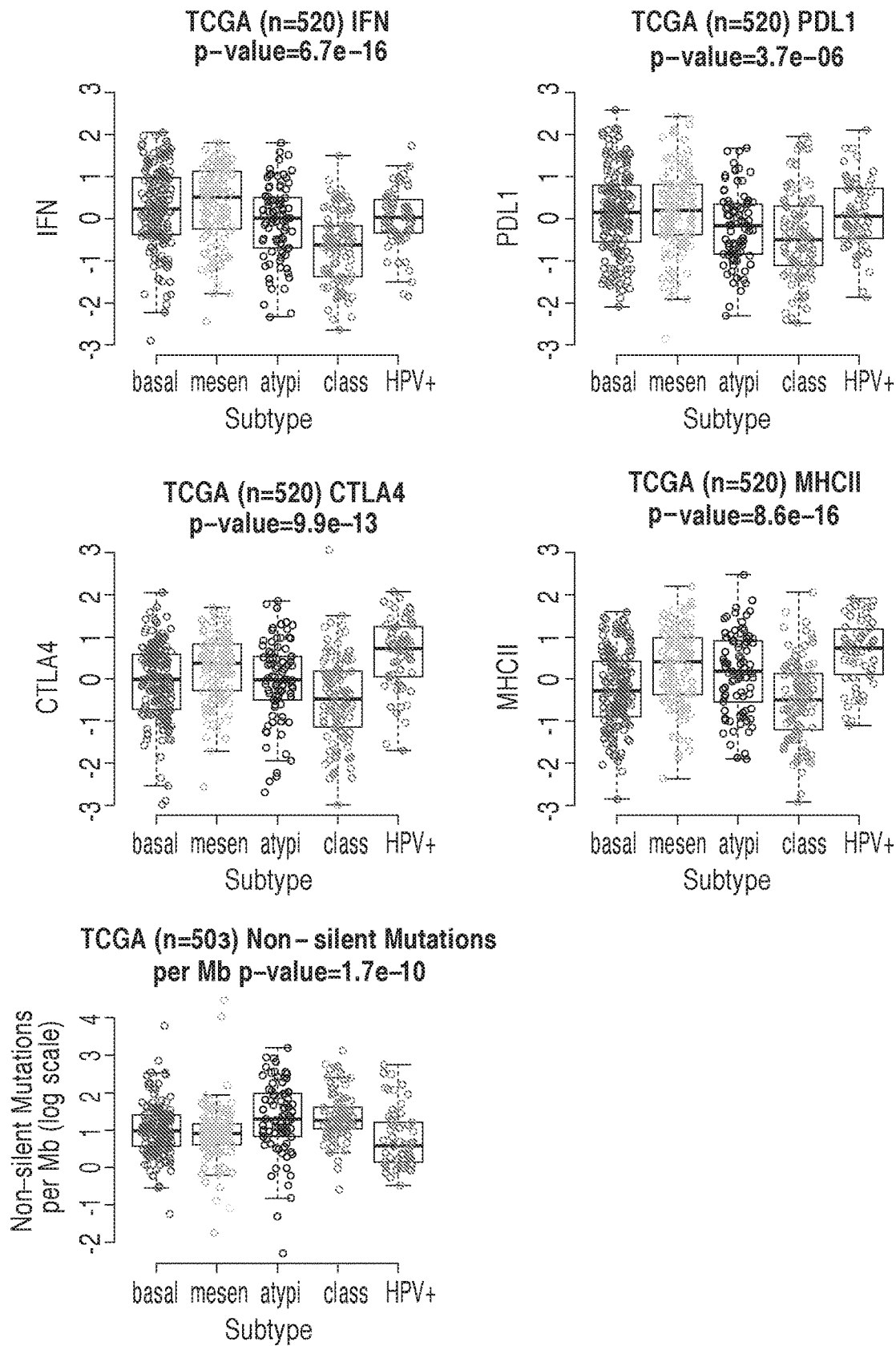

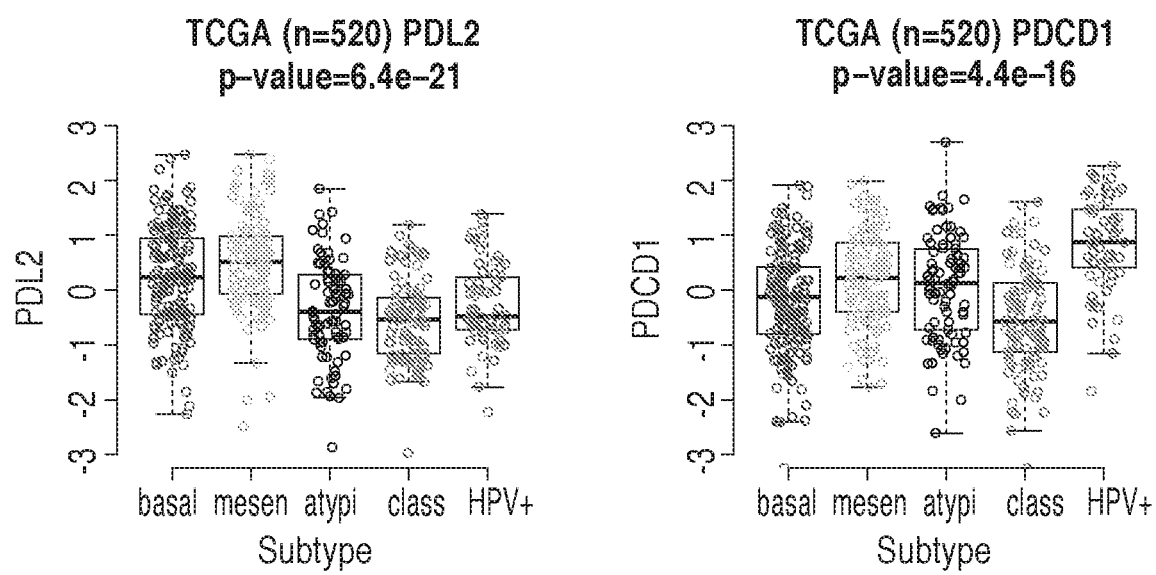
FIG. 6 (Contd)

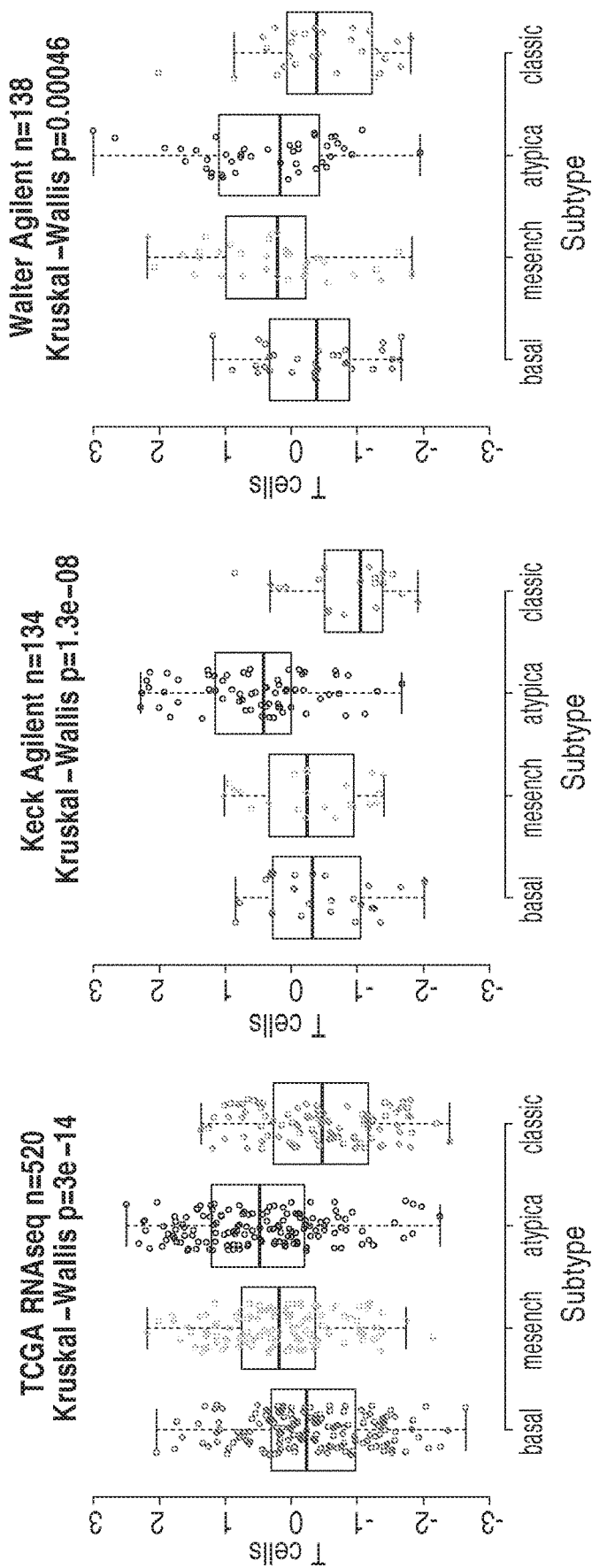
FIG. 9 (Contd)

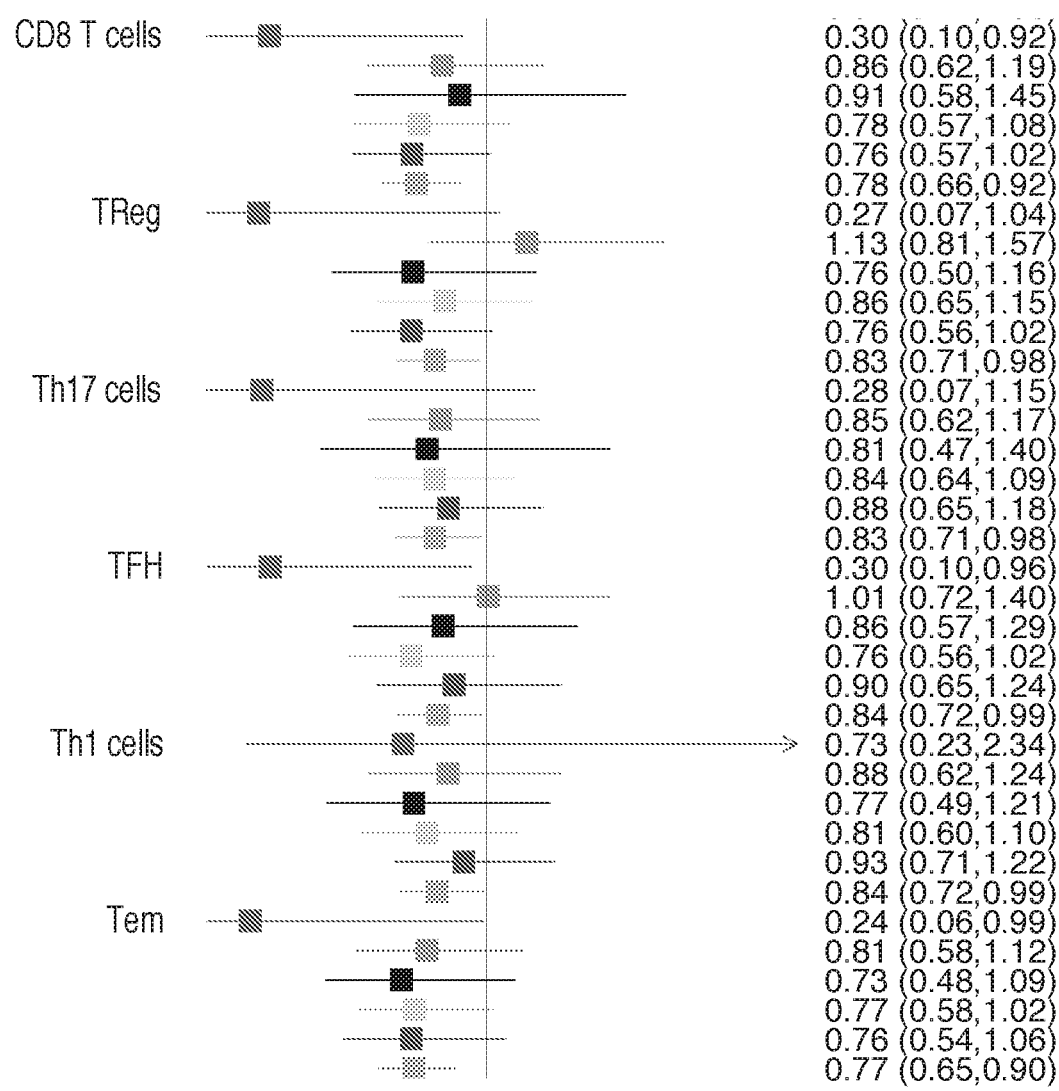
FIG. 10 (Contd)

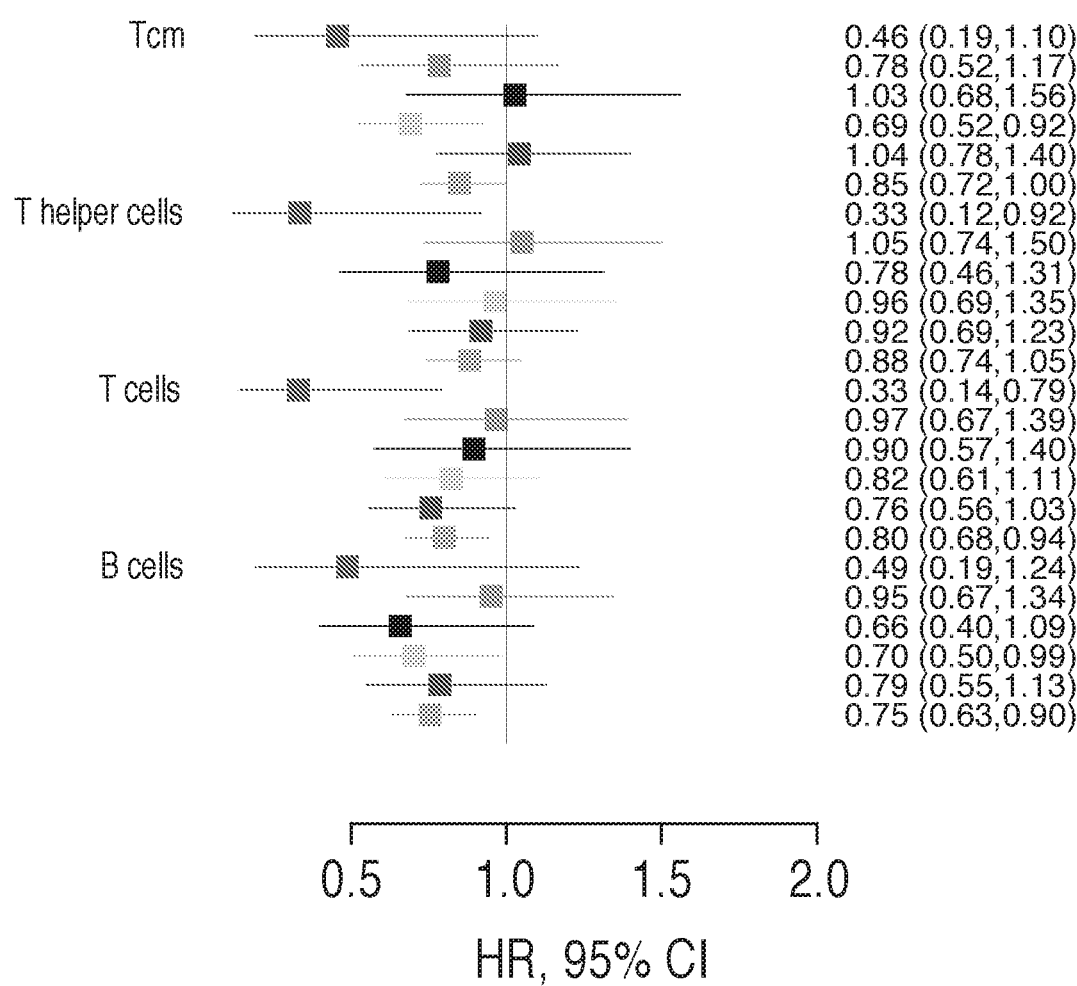
FIG. 10 (Contd)

|  |  | TCGA [2] | Keck [4] | Walter [3] | Wichman [5] |
|---|---|---|---|---|---|
| patients | n | 520 | 134 | 138 | 270 |
| age | median | 61 | 57 | 57 | 59 |
|  | NA | 1 | 4 | 0 | 0 |
| site | HP | 10 (2%) | 9 (7%) | 13 (10%) | 33 (12%) |
|  | LX | 116 (22%) | 23 (17%) | 30 (23%) | 48 (18%) |
|  | OC | 315 (61%) | 25 (19%) | 55 (42%) | 83 (31%) |
|  | OP | 79 (15%) | 76 (57%) | 34 (26%) | 102 (38%) |
|  | NA | 0 | 1 | 6 | 4 |
| hpv | + | 71 (14%) | 58 (43%) |  |  |
|  | - | 449 (86%) | 76 (57%) |  |  |
|  | NA | 0 | 0 | 138 | 270 |
| smoke.ever | yes | 391 (77%) | 108 (83%) | 109 (80%) | 222 (82%) |
|  | no | 117 (23%) | 22 (17%) | 27 (20%) | 48 (18%) |
|  | NA | 12 | 4 | 2 | 0 |
| T | T0-T2 | 185 (40%) | 43 (33%) | 40 (34%) | 115 (43%) |
|  | T3-T4 | 273 (60%) | 87 (67%) | 77 (66%) | 155 (57%) |
|  | NA | 62 | 4 | 21 | 0 |
| N | N0 | 176 (42%) | 12 (9%) | 51 (44%) | 94 (35%) |
|  | N1 | 67 (16%) | 9 (7%) | 15 (13%) | 32 (12%) |
|  | N2 | 169 (40%) | 90 (69%) | 46 (39%) | 132 (49%) |
|  | N3 | 8 (2%) | 19 (15%) | 5 (4%) | 12 (4%) |
|  | NA | 100 | 4 | 21 | 0 |
| M | M0 | 186 (99%) |  |  | 263 (97%) |
|  | M1 | 1 (1%) |  |  | 7 (3%) |
|  | NA | 333 | 134 | 138 | 0 |

FIG. 11

| gold standard (rows) vs 144-gene subtyper (columns) | | | | | | |
|---|---|---|---|---|---|---|
| | | atypical | basal | classical | mesench | Sum |
| keck | atypical | 60 | 2 | 4 | 0 | 66 |
| | basal | 0 | 18 | 0 | 2 | 20 |
| | classical | 2 | 3 | 15 | 1 | 21 |
| | mesenchymal | 4 | 2 | 2 | 19 | 27 |
| | Sum | 66 | 25 | 21 | 22 | 134 |
| tcga | atypical | 131 | 3 | 7 | 0 | 141 |
| | basal | 3 | 134 | 0 | 12 | 149 |
| | classical | 4 | 2 | 79 | 7 | 92 |
| | mesenchymal | 5 | 12 | 12 | 109 | 138 |
| | Sum | 143 | 151 | 98 | 128 | 520 |
| walt | atypical | 35 | 0 | 0 | 0 | 35 |
| | basal | 3 | 30 | 1 | 4 | 38 |
| | classical | 2 | 0 | 24 | 2 | 28 |
| | mesenchymal | 3 | 2 | 3 | 29 | 37 |
| | Sum | 43 | 32 | 28 | 35 | 138 |
| wich | atypical | 86 | 5 | 0 | 1 | 92 |
| | basal | 0 | 47 | 0 | 9 | 56 |
| | classical | 3 | 4 | 30 | 8 | 45 |
| | mesenchymal | 5 | 7 | 5 | 60 | 77 |
| | Sum | 94 | 63 | 35 | 78 | 270 |
| Sum | atypical | 312 | 10 | 11 | 1 | 334 |
| | basal | 6 | 229 | 1 | 27 | 263 |
| | classical | 11 | 9 | 148 | 18 | 186 |
| | mesenchymal | 17 | 23 | 22 | 217 | 279 |
| | Sum | 346 | 271 | 182 | 263 | 1062 |

| keck | tcga | walt | wich |
|---|---|---|---|
| 0.84 | 0.87 | 0.86 | 0.83 |

FIG. 12

| TCGA: HPV RNAseq>1000 (rows) vs GS subtype | | | | | |
|---|---|---|---|---|---|
|  | atypical | basal | classical | mesenchymal | Sum |
| negative | 81 | 146 | 89 | 133 | 449 |
| positive | 60 | 3 | 3 | 5 | 71 |
| Sum | 141 | 149 | 92 | 138 | 520 |

| TCGA: HPV RNAseq>1000 (rows) vs 144-gene subtype | | | | | |
|---|---|---|---|---|---|
|  | atypical | basal | classical | mesenchymal | Sum |
| negative | 82 | 148 | 94 | 125 | 449 |
| positive | 61 | 3 | 4 | 3 | 71 |
| Sum | 143 | 151 | 98 | 128 | 520 |

| Keck: HPV E6 PCR (rows) vs GS subtype | | | | | |
|---|---|---|---|---|---|
|  | atypical | basal | classical | mesenchymal | Sum |
| negative | 20 | 20 | 21 | 15 | 76 |
| positive | 46 | 0 | 0 | 12 | 58 |
| Sum | 66 | 20 | 21 | 27 | 134 |

| Keck: HPV E6 PCR (rows) vs 144-gene subtype | | | | | |
|---|---|---|---|---|---|
|  | atypical | basal | classical | mesenchymal | Sum |
| negative | 16 | 24 | 20 | 16 | 76 |
| positive | 50 | 1 | 1 | 6 | 58 |
| Sum | 66 | 25 | 21 | 22 | 134 |

FIG. 13

| rows are gold standard and columns are predictions | | | | | |
|---|---|---|---|---|---|
| | | atypical | basal | classical | mesenchymal |
| keck | atypical | 48 | 1 | 2 | 0 |
| | basal | 0 | 21 | 0 | 6 |
| | classical | 2 | 2 | 17 | 6 |
| | mesenchyma | 1 | 3 | 2 | 23 |
| tcga | atypical | 130 | 3 | 8 | 0 |
| | basal | 5 | 128 | 0 | 16 |
| | classical | 6 | 3 | 72 | 11 |
| | mesenchyma | 5 | 15 | 12 | 106 |
| walter | atypical | 34 | 0 | 1 | 0 |
| | basal | 4 | 29 | 1 | 4 |
| | classical | 2 | 0 | 24 | 2 |
| | mesenchyma | 3 | 3 | 3 | 28 |
| wichmann | atypical | 86 | 3 | 1 | 2 |
| | basal | 1 | 46 | 0 | 9 |
| | classical | 3 | 3 | 29 | 10 |
| | mesenchyma | 4 | 2 | 11 | 60 |

| keck | tcga | walt | wich |
|---|---|---|---|
| 0.81 | 0.84 | 0.83 | 0.82 |

FIG. 14

- Gold Standard subtype agreement using 80-gene and 144-gene signatures in TCGA dataset (n=520)

|  | subtype.80 | subtype.144 |
|---|---|---|
| overall | 0.84 | 0.87 |
| atypical | 0.92 | 0.93 |
| basal | 0.86 | 0.9 |
| classical | 0.78 | 0.86 |
| mesenchymal | 0.77 | 0.79 |

FIG. 15

| Stage | TCGA (n=520) | Keck et al (n=134) | Walter et al (n=138) | Wichman et al (n=270) |
|---|---|---|---|---|
| I | 27(6%) | 0(0%) | 8(6%) | 18(7%) |
| II | 74(16%) | 0(0%) | 14(10%) | 37(14%) |
| III | 81(18%) | 3(2%) | 28(21%) | 37(14%) |
| IV | 267(59%) | 124(98%) | 84(63%) | 178(66%) |
| NA | 71 | 7 | 4 | 0 |

METHODS FOR SUBTYPING OF HEAD AND NECK SQUAMOUS CELL CARCINOMA

CROSS-REFERENCE TO RELATED APPLICATIONS

This application is a U.S. national stage application of International Application No. PCT/US2018/045522, filed Aug. 7, 2018, which claims the benefit of priority to U.S. Provisional Application No. 62/541,960 filed Aug. 7, 2017, U.S. Provisional Application No. 62/608,218 filed Dec. 20, 2017, and U.S. Provisional Application No. 62/629,934 filed Feb. 13, 2018, each of which are incorporated by reference herein in their entireties for all purposes.

FIELD OF THE INVENTION

The present invention relates to methods for determining a squamous cell carcinoma subtype of a head and neck sample and for predicting the response to a treatment for a patient inflicted with specific subtypes of head and neck cancer.

STATEMENT REGARDING SEQUENCE LISTING

The Sequence Listing associated with this application is provided in text format in lieu of a paper copy, and is hereby incorporated by reference into the specification. The name of the text file containing the Sequence Listing is GNCN_011_03WO_SeqList_ST25.txt. The text file is ~674 KB, and was created on Aug. 2, 2018, and is being submitted electronically via EFS-Web.

BACKGROUND OF THE INVENTION

Head and Neck Squamous Cell Carcinoma (HNSCC) is comprised of cancers arising from the oral cavity, oropharynx, nasopharynx, hypopharynx, and larynx and are responsible for approximately 3% of all malignancies (NCI HNSCC www.cancer.gov/types/head-and-neck/hp accessed 6-7-17). The most significant predisposing factors include heavy smoking and/or alcohol use, and more recently an increasing proportion of HNSCC tumors are caused by Human Papilloma Virus (HPV) Infection. In the United States, it is projected that in 2015, there were approximately 60,000 new cases and 12,000 deaths of HNSCCC (see Siegel R L, Miller K D, Jemal A. Cancer Statistics, 2015. CA Cancer J Clin. 2015; 65: 5-29). HNSCC has been traditionally managed with surgery, radiation therapy, and/or chemotherapy such that early stage tumors are often managed with a single treatment modality while advanced stage tumors require multimodality therapy. Risk stratification and treatment decisions vary by anatomic site, stage at presentation, histologic characteristics of the tumor, and patient factors.

Recent advances in cancer genomics have led to an increased understanding of mutational and gene expression profiles in HNSCC. HNSCC subtypes, as defined by underlying genomic features, have shown varied cell of origin, tumor drivers, proliferation, immune responses, and prognosis (Lawrence M S, Sougnez C, Lichtenstein L, Cibulskis K, Lander E, Gabriel S B, et al. Comprehensive genomic characterization of head and neck squamous cell carcinomas. Nature. 2015; 517: 576-582; Von Walter, Yin X, Wilkerson M D, Cabanski C R, Zhao N, Du Y, Ang M K, Hayward M C, Salazar A H, Hoadley K A, Fritchie K, Sailey C J, Weissler M C, Shockley W W, Zanation A M, Hackman T, Thorne L B, Funkhouser W D, Muldrew K L, Olshan A F, Randell S H, Wright F A, Shores C G, Hayes D N. (2013). Molecular Subtypes in Head and Neck Cancer Exhibit Distinct Patterns of Chromosomal Gain and Loss of Canonical Cancer Genes. PLoS One, 8(2):e56823; Keck M K, Zuo Z, Khattri a., Stricker T P, Brown C D, Imanguli M, et al. Integrative Analysis of Head and Neck Cancer Identifies Two Biologically Distinct HPV and Three Non-HPV Subtypes. Clin Cancer Res. 2014; 21: 870-881). Currently, HNSCC tumors can be categorized into one of 4 subtypes (Atypical (AT), Mesenchymal (MS), Classical (CL), Basal (BA)). Additionally, while traditionally associated with tobacco and alcohol use, an increased number of incident oropharyngeal cancers are caused by human papillomavirus (HPV).

Accordingly, there has been a growing interest in studies of HPV associated HNSCC tumors. With the exception of the use of P16 immunohistochemistry as a marker of HPV infection in oropharyngeal tumors, the molecular characteristics of HPV-associated HNSCC have largely not been incorporated into risk stratification, drug response stratification, nor clinical management decisions (chemotherapy, etc).

Cancer immunosurveillance is the principle that the immune system can identify precancerous and cancerous cells and kill these cells before they become clinically relevant, which has been demonstrated in immunodeficient mouse models. Innate and adaptive immune responses can work together to either promote or inhibit cancer growth, and evasion of immune destruction is an emerging hallmark of cancer. Deficiencies in tumor antigen expression and presentation on antigen presenting cells (APCs), infiltration of immunosuppressive cells and cytokines, and ineffective T-cell activation can lead to immunosuppression at the tumor site. Advances in the understanding of cancer and the immune system have led to effective therapies that activate antitumor responses, even in tumors that have highly developed methods of immune evasion. However the high immunosuppressive effects caused by some types of tumors limit the beneficial effects of these advances due to a delicate balance between immunoactivation and immunosuppression in a patient. Accordingly, new methods are needed to further define populations that might be likely to respond to immunotherapy.

The present invention addresses these and other needs in the field for an efficient method for improved HNSCC tumor classification that could inform prognosis, drug response and patient management based on underlying genomic and biologic tumor characteristics. The diagnostic method includes evaluation of gene expression subtypes followed by HPV gene expression and application of an algorithm for categorization of HNSCC tumors into one of 5 subtypes (Atypical (AT), Mesenchymal (MS), Classical (CL), Basal (BA), and HPV "Atypical-like").

SUMMARY OF THE INVENTION

In one aspect, provided herein is a method for determining a head and neck squamous cell carcinoma (HNSCC) subtype of a head and neck tissue sample obtained from a patient, the method comprising detecting an expression level of at least one classifier biomarker of Table 1 or Table 3, wherein the detection of the expression level of the classifier biomarker specifically identifies a basal (BA), mesenchymal (MS), atypical (AT) or classical (CL) HNSCC subtype. In some cases, the method further comprises comparing the detected levels of expression of the at least one classifier biomarkers of Table 1 or Table 3 to the expression of the at least one classifier biomarkers of Table 1 or Table 3 in at least one sample training set(s), wherein the at least one sample training set comprises expression data of the at least one classifier biomarkers of Table 1 or Table 3 from a reference HNSCC BA sample, expression data of the at least one classifier biomarkers of Table 1 or Table 3 from a reference HNSCC MS sample, expression data of the at least one classifier biomarkers of Table 1 or Table 3 from a reference HNSCC AT sample, expression data of the at least one classifier biomarkers of Table 1 or Table 3 from a reference HNSCC CL sample or a combination thereof; and classifying the sample as BA, MS, AT or CL subtype based on the results of the comparing step. In some cases, the comparing step comprises applying a statistical algorithm which comprises determining a correlation between the expression data obtained from the sample and the expression data from the at least one training set(s); and classifying the sample as a BA, MS, AT or CL subtype based on the results of the statistical algorithm. In some cases, the expression level of the classifier biomarker is detected at the nucleic acid level. In some cases, the nucleic acid level is RNA or cDNA. In some cases, the detecting an expression level comprises performing quantitative real time reverse transcriptase polymerase chain reaction (qRT-PCR), RNAseq, microarrays, gene chips, nCounter Gene Expression Assay, Serial Analysis of Gene Expression (SAGE), Rapid Analysis of Gene Expression (RAGE), nuclease protection assays, Northern blotting, or any other equivalent gene expression detection techniques. In some cases, the expression level is detected by performing qRT-PCR. In some cases, the detection of the expression level comprises using at least one pair of oligonucleotide primers specific for at least one classifier biomarker of Table 1 or Table 3. In some cases, the sample is a formalin-fixed, paraffin-embedded (FFPE) head and neck tissue sample, fresh or a frozen tissue sample, an exosome, wash fluids, cell pellets, or a bodily fluid obtained from the patient. In some cases, the bodily fluid is blood or fractions thereof, urine, saliva, or sputum. In some cases, the at least one classifier biomarker comprises a plurality of classifier biomarkers. In some cases, the plurality of classifier biomarkers comprises at least two classifier biomarkers, at least 9 classifier biomarkers, at least 18 classifier biomarkers, at least 36 classifier biomarkers, at least 54 classifier biomarkers, at least 72 classifier biomarkers, at least 90 classifier biomarkers, at least 108 classifier biomarkers, at least 126 classifier biomarkers or at least 144 classifier biomarkers of Table 1. In some cases, the at least one classifier biomarker comprises all the classifier biomarkers of Table 1. In some cases, the plurality of classifier biomarkers comprises at least two classifier biomarkers, at least 5 classifier biomarkers, at least 10 classifier biomarkers, at least 20 classifier biomarkers, at least 30 classifier biomarkers, at least 40 classifier biomarkers, at least 50 classifier biomarkers, at least 60 classifier biomarkers, at least 70 classifier biomarkers or at least 80 classifier biomarkers of Table 3. In some cases, the at least one classifier biomarker comprises all the classifier biomarkers of Table 3. In some cases, the method further comprises determining the HPV status of the patient. In some cases, the determining the HPV status of the patient comprises measuring the expression of one or more HPV genes in the tissue sample obtained from the patient. In some cases, the one or more HPV genes is the E6 gene, the E7 gene, the E6 and E7 genes or the E6 and E7 genes in combination with one or more additional genes from the HPV genome.

In another aspect, provided herein is a method for determining a HNSCC subtype of a head and neck tissue sample obtained from a patient comprising detecting an expression level of at least one nucleic acid molecule that encodes a classifier biomarker having a specific expression pattern in head and neck cancer cells, wherein the classifier biomarker is selected from the group consisting of the classifier genes set forth in Table 1 or Table 3, the method comprising: (a) isolating nucleic acid material from a head and neck tissue sample from a patient; (b) mixing the nucleic acid material with oligonucleotides that are substantially complementary to portions of nucleic acid molecule of the classifier biomarker; and (c) detecting expression of the classifier biomarker. In some cases, the method further comprises comparing the detected levels of expression of the at least one classifier biomarkers of Table 1 or Table 3 to the expression of the at least one classifier biomarkers of Table 1 or Table 3 in at least one sample training set(s), wherein the at least one sample training set comprises expression data of the at least one classifier biomarkers of Table 1 or Table 3 from a reference HNSCC BA sample, expression data of the at least one classifier biomarkers of Table 1 or Table 3 from a reference HNSCC MS sample, expression data of the at least one classifier biomarkers of Table 1 or Table 3 from a reference HNSCC AT sample, expression data of the at least one classifier biomarkers of Table 1 or Table 3 from a reference HNSCC CL sample or a combination thereof; and classifying the sample as BA, MS, AT or CL subtype based on the results of the comparing step. In some cases, the comparing step comprises applying a statistical algorithm which comprises determining a correlation between the expression data obtained from the sample and the expression data from the at least one training set(s); and classifying the sample as a BA, MS, AT or CL subtype based on the results of the statistical algorithm. In some cases, the detecting the expression level comprises performing qRT-PCR or any hybridization-based gene assays. In some cases, the expression level is detected by performing qRT-PCR. In some cases, the detection of the expression level comprises using at least one pair of oligonucleotide primers specific for at least one classifier biomarker of Table 1 or Table 3. In some cases, the method further comprises predicting the response to a therapy for treating a subtype of HNSCC based on the detected expression level of the classifier biomarker. In some cases, the therapy is radiotherapy, surgical intervention, chemotherapy, angiogenesis inhibitors and/or immunotherapy. In some cases, the sample is a formalin-fixed, paraffin-embedded (FFPE) head and neck tissue sample, fresh or a frozen tissue sample, an exosome, wash fluids, cell pellets or a bodily fluid obtained from the patient. In some cases, the bodily fluid is blood or fractions thereof, urine, saliva, or sputum. In some cases, the at least one nucleic acid molecule that encodes a classifier biomarker comprises a plurality of nucleic acid molecules that encode a plurality of classifier biomarkers. In some cases, the plurality of classifier biomarkers comprises at least two classifier biomarkers, at least 9 classifier biomarkers, at least 18 classifier biomarkers, at least 36 classifier biomarkers, at least 54 classifier biomarkers, at least 72 classifier biomarkers, at least 90 classifier biomarkers, at least 108 classifier biomarkers, at least 126 classifier biomarkers or at least 144 classifier biomarkers of Table 1. In some cases, the at least one classifier biomarker comprises all the classifier biomarkers of Table 1. In some cases, the plurality of classifier biomarkers comprises at least two classifier biomarkers, at least 5 classifier biomarkers, at least 10 classifier biomarkers, at least 20 classifier biomarkers, at least 30 classifier biomarkers, at least 40 classifier biomarkers, at least 50 classifier biomarkers, at least 60 classifier biomarkers, at least 70 classifier biomarkers or at least 80 classifier biomarkers of Table 3. In some cases, the at least one classifier biomarker comprises all the classifier biomarkers of Table 3. In some cases, the method further comprises determining the HPV status of the patient. In some cases, the determining the HPV status of the patient comprises measuring the expression of one or more HPV genes in the tissue sample obtained from the patient. In some cases, the one or more HPV genes is the E6 gene, the E7 gene, the E6 and E7 genes or the E6 and E7 genes in combination with one or more additional genes from the HPV genome.

In still another aspect, provided herein is a method of detecting a biomarker in a head and neck tissue sample obtained from a patient, the method comprising measuring the expression level of a plurality of biomarker nucleic acids selected from Table 1 or Table 3 using an amplification, hybridization and/or sequencing assay. In some cases, the head neck tissue sample was previously diagnosed as being squamous cell carcinoma. In some cases, the previous diagnosis was by histological examination. In some cases, the amplification, hybridization and/or sequencing assay comprises performing quantitative real time reverse transcriptase polymerase chain reaction (qRT-PCR), RNAseq, microarrays, gene chips, nCounter Gene Expression Assay, Serial Analysis of Gene Expression (SAGE), Rapid Analysis of Gene Expression (RAGE), nuclease protection assays, Northern blotting, or any other equivalent gene expression detection techniques. In some cases, the expression level is detected by performing qRT-PCR. In some cases, the detection of the expression level comprises using at least one pair of oligonucleotide primers per each of the plurality of biomarker nucleic acids selected from Table 1 or Table 3. In some cases, the sample is a formalin-fixed, paraffin-embedded (FFPE) head and neck tissue sample, fresh or a frozen tissue sample, an exosome, wash fluids, cell pellets, or a bodily fluid obtained from the patient. In some cases, the bodily fluid is blood or fractions thereof, urine, saliva, or sputum. In some cases, the plurality of biomarker nucleic acids comprises, consists essentially of or consists of at least two biomarker nucleic acids, at least 18 biomarker nucleic acids, at least 36 biomarker nucleic acids, at least 54 biomarker nucleic acids, at least 72 biomarker nucleic acids, at least 90 biomarker nucleic acids, at least 108 biomarker nucleic acids, at least 126 biomarker nucleic acids, or at least 144 biomarker nucleic acids of Table 1. In some cases, the plurality of biomarker nucleic acids comprises, consists essentially of or consists of all the classifier biomarker nucleic acids of Table 1. In some cases, the plurality of biomarker nucleic acids comprises, consists essentially of or consists of at least two biomarker nucleic acids, at least 10 biomarker nucleic acids, at least 20 biomarker nucleic acids, at least 30 biomarker nucleic acids, at least 40 biomarker nucleic acids, at least 50 biomarker nucleic acids, at least 60 biomarker nucleic acids, at least 70 biomarker nucleic acids, or at least 80 biomarker nucleic acids of Table 3. In some cases, the plurality of biomarker nucleic acids comprises, consists essentially of or consists of all the classifier biomarker nucleic acids of Table 3. In some cases, the method further comprises determining the HPV status of the patient. In some cases, the determining the HPV status of the patient comprises measuring the expression of one or more HPV genes in the tissue sample obtained from the patient. In some cases, the one or more HPV genes is the E6 gene, the E7 gene, the E6 and E7 genes or the E6 and E7 genes in combination with one or more additional genes from the HPV genome.

In yet another aspect, provided herein is a method of detecting a biomarker in a head and neck tissue sample obtained from a patient, the method consisting essentially of measuring the expression level of a plurality of biomarker nucleic acids selected from Table 1 or Table 3 using an amplification, hybridization and/or sequencing assay. In some cases, the head and neck tissue sample was previously diagnosed as being squamous cell carcinoma. In some cases, the previous diagnosis was by histological examination. In some cases, the amplification, hybridization and/or sequencing assay comprises performing quantitative real time reverse transcriptase polymerase chain reaction (qRT-PCR), RNAseq, microarrays, gene chips, nCounter Gene Expression Assay, Serial Analysis of Gene Expression (SAGE), Rapid Analysis of Gene Expression (RAGE), nuclease protection assays, Northern blotting, or any other equivalent gene expression detection techniques. In some cases, the expression level is detected by performing qRT-PCR. In some cases, the detection of the expression level comprises using at least one pair of oligonucleotide primers per each of the plurality of biomarker nucleic acids selected from Table 1 or Table 3. In some cases, the sample is a formalin-fixed, paraffin-embedded (FFPE) head and neck tissue sample, fresh or a frozen tissue sample, an exosome, wash fluids, cell pellets, or a bodily fluid obtained from the patient. In some cases, the bodily fluid is blood or fractions thereof, urine, saliva, or sputum. In some cases, the plurality of biomarker nucleic acids comprises, consists essentially of or consists of at least two biomarker nucleic acids, at least 18 biomarker nucleic acids, at least 36 biomarker nucleic acids, at least 54 biomarker nucleic acids, at least 72 biomarker nucleic acids, at least 90 biomarker nucleic acids, at least 108 biomarker nucleic acids, at least 126 biomarker nucleic acids, or at least 144 biomarker nucleic acids of Table 1. In some cases, the plurality of biomarker nucleic acids comprises, consists essentially of or consists of all the classifier biomarker nucleic acids of Table 1. In some cases, the plurality of biomarker nucleic acids comprises, consists essentially of or consists of at least two biomarker nucleic acids, at least 10 biomarker nucleic acids, at least 20 biomarker nucleic acids, at least 30 biomarker nucleic acids, at least 40 biomarker nucleic acids, at least 50 biomarker nucleic acids, at least 60 biomarker nucleic acids, at least 70 biomarker nucleic acids, or at least 80 biomarker nucleic acids of Table 3. In some cases, the plurality of biomarker nucleic acids comprises, consists essentially of or consists of all the classifier biomarker nucleic acids of Table 3. In some cases, the method further comprises determining the HPV status of the patient. In some cases, the determining the HPV status of the patient comprises measuring the expression of one or more HPV genes in the tissue sample obtained from the patient. In some cases, the one or more HPV genes is the E6 gene, the E7 gene, the E6 and E7 genes or the E6 and E7 genes in combination with one or more additional genes from the HPV genome.

In still yet another aspect, provided herein is a method of detecting a biomarker in a head and neck tissue sample obtained from a patient, the method consisting of measuring the expression level of a plurality of biomarker nucleic acids selected from Table 1 or Table 3 using an amplification, hybridization and/or sequencing assay. In some cases, the head and neck tissue sample was previously diagnosed as being squamous cell carcinoma. In some cases, the previous diagnosis was by histological examination. In some cases, the amplification, hybridization and/or sequencing assay comprises performing quantitative real time reverse transcriptase polymerase chain reaction (qRT-PCR), RNAseq, microarrays, gene chips, nCounter Gene Expression Assay, Serial Analysis of Gene Expression (SAGE), Rapid Analysis of Gene Expression (RAGE), nuclease protection assays, Northern blotting, or any other equivalent gene expression detection techniques. In some cases, the expression level is detected by performing qRT-PCR. In some cases, the detection of the expression level comprises using at least one pair of oligonucleotide primers per each of the plurality of biomarker nucleic acids selected from Table 1 or Table 3. In some cases, the sample is a formalin-fixed, paraffin-embedded (FFPE) head and neck tissue sample, fresh or a frozen tissue sample, an exosome, wash fluids, cell pellets, or a bodily fluid obtained from the patient. In some cases, the bodily fluid is blood or fractions thereof, urine, saliva, or sputum. In some cases, the plurality of biomarker nucleic acids comprises, consists essentially of or consists of at least two biomarker nucleic acids, at least 18 biomarker nucleic acids, at least 36 biomarker nucleic acids, at least 54 biomarker nucleic acids, at least 72 biomarker nucleic acids, at least 90 biomarker nucleic acids, at least 108 biomarker nucleic acids, at least 126 biomarker nucleic acids, or at least 144 biomarker nucleic acids of Table 1. In some cases, the plurality of biomarker nucleic acids comprises, consists essentially of or consists of all the classifier biomarker nucleic acids of Table 1. In some cases, the plurality of biomarker nucleic acids comprises, consists essentially of or consists of at least two biomarker nucleic acids, at least 10 biomarker nucleic acids, at least 20 biomarker nucleic acids, at least 30 biomarker nucleic acids, at least 40 biomarker nucleic acids, at least 50 biomarker nucleic acids, at least 60 biomarker nucleic acids, at least 70 biomarker nucleic acids, or at least 80 biomarker nucleic acids of Table 3. In some cases, the plurality of biomarker nucleic acids comprises, consists essentially of or consists of all the classifier biomarker nucleic acids of Table 3. In some cases, the method further comprises determining the HPV status of the patient. In some cases, the determining the HPV status of the patient comprises measuring the expression of one or more HPV genes in the tissue sample obtained from the patient. In some cases, the one or more HPV genes is the E6 gene, the E7 gene, the E6 and E7 genes or the E6 and E7 genes in combination with one or more additional genes from the HPV genome.

In one aspect, provided herein is a method of determining whether a HNSCC patient is likely to respond to immunotherapy, the method comprising: determining the HNSCC subtype of a head and neck tissue sample from the patient, wherein the HNSCC subtype is selected from the group consisting of basal, mesenchymal, atypical and classical; and based on the subtype, assessing whether the patient is likely to respond to immunotherapy. In some cases, the immunotherapy comprises checkpoint inhibitor therapy. In some cases, the checkpoint inhibitor targets PD-1 or PD-L1. In some cases, the checkpoint inhibitor targets CTLA-4. In some cases, the checkpoint inhibitor is Pembrolizumab, Nivolumab or an antigen fragment binding fragment thereof. In some cases, the checkpoint inhibitor is Ipilimumab or an antigen binding fragment thereof. In some cases, the patient is initially determined to have HNSCC via a histological analysis of a sample. In some cases, the patient's HNSCC molecular subtype is selected from basal, mesenchymal, atypical or classical and is determined via a histological analysis of a sample obtained from the patient. In some cases, the sample is a formalin-fixed, paraffin-embedded (FFPE) head and neck tissue sample, fresh or a frozen tissue sample, an exosome, or a bodily fluid obtained from the patient. In some cases, the bodily fluid is blood or fractions thereof, urine, saliva, or sputum. In some cases, the determining the HNSCC subtype comprises determining expression levels of a plurality of classifier biomarkers. In some cases, the determining the expression levels of the plurality of classifier biomarkers is at a nucleic acid level by performing RNA sequencing, reverse transcriptase polymerase chain reaction (RT-PCR) or hybridization based analyses. In some cases, the plurality of classifier biomarkers for determining the HNSCC subtype is selected from a publically available HNSCC dataset. In some cases, the publically available HNSCC dataset is TCGA HNSCC RNAseq dataset. In some cases, the plurality of classifier biomarkers for determining the HNSCC subtype is selected from Table 1 or Table 3. In some cases, the RT-PCR is quantitative real time reverse transcriptase polymerase chain reaction (qRT-PCR). In some cases, the RT-PCR is performed with primers specific to the plurality of classifier biomarkers of Table 1 or Table 3. In some cases, the method further comprises comparing the detected levels of expression of the plurality of classifier biomarkers of Table 1 or Table 3 to the expression of the plurality of classifier biomarkers of Table 1 or Table 3 in at least one sample training set(s), wherein the at least one sample training set comprises expression data of the plurality of classifier biomarkers of Table 1 or Table 3 from a reference HNSCC BA sample, expression data of the plurality of classifier biomarkers of Table 1 or Table 3 from a reference HNSCC MS sample, expression data of the plurality of classifier biomarkers of Table 1 or Table 3 from a reference HNSCC AT sample, expression data of the plurality of classifier biomarkers of Table 1 or Table 3 from a reference HNSCC CL sample or a combination thereof; and classifying the first sample as BA, MS, AT or CL based on the results of the comparing step. In some cases, the comparing step comprises applying a statistical algorithm which comprises determining a correlation between the expression data obtained from the sample and the expression data from the at least one training set(s); and classifying the sample as a BA, MS, AT or CL subtype based on the results of the statistical algorithm. In some cases, the plurality of the classifier biomarkers comprise each of the classifier biomarkers set forth in Table 1 or Table 3. In some cases, the method further comprises determining the HPV status of the patient. In some cases, the determining the HPV status of the patient comprises measuring the expression of one or more HPV genes in the tissue sample obtained from the patient. In some cases, the one or more HPV genes is the E6 gene, the E7 gene, the E6 and E7 genes or the E6 and E7 genes in combination with one or more additional genes from the HPV genome.

In another aspect, provided herein is a method for selecting a HNSCC patient for immunotherapy, the method comprising, determining a HNSCC subtype of a head and neck tissue sample from the patient, based on the subtype; and selecting the patient for immunotherapy. In some cases, the immunotherapy comprises checkpoint inhibitor therapy. In some cases, the checkpoint inhibitor targets PD-1 or PD-L1. In some cases, the checkpoint inhibitor targets CTLA-4. In some cases, the checkpoint inhibitor is Pembrolizumab, Nivolumab or an antigen fragment binding fragment thereof. In some cases, the checkpoint inhibitor is Ipilimumab or an antigen binding fragment thereof. In some cases, the patient is initially determined to have HNSCC via a histological analysis of a sample. In some cases, the patient's HNSCC molecular subtype is selected from basal, mesenchymal, atypical or classical and is determined via a histological analysis of a sample obtained from the patient. In some cases, the sample is a formalin-fixed, paraffin-embedded (FFPE) head and neck tissue sample, fresh or a frozen tissue sample, an exosome, or a bodily fluid obtained from the patient. In some cases, the bodily fluid is blood or fractions thereof, urine, saliva, or sputum. In some cases, the determining the HNSCC subtype comprises determining expression levels of a plurality of classifier biomarkers. In some cases, the determining the expression levels of the plurality of classifier biomarkers is at a nucleic acid level by performing RNA sequencing, reverse transcriptase polymerase chain reaction (RT-PCR) or hybridization based analyses. In some cases, the plurality of classifier biomarkers for determining the HNSCC subtype is selected from a publically available HNSCC dataset. In some cases, the publically available HNSCC dataset is TCGA HNSCC RNAseq dataset. In some cases, the plurality of classifier biomarkers for determining the HNSCC subtype is selected from Table 1 or Table 3. In some cases, the RT-PCR is quantitative real time reverse transcriptase polymerase chain reaction (qRT-PCR). In some cases, the RT-PCR is performed with primers specific to the plurality of classifier biomarkers of Table 1 or Table 3. In some cases, the method further comprises comparing the detected levels of expression of the plurality of classifier biomarkers of Table 1 or Table 3 to the expression of the plurality of classifier biomarkers of Table 1 or Table 3 in at least one sample training set(s), wherein the at least one sample training set comprises expression data of the plurality of classifier biomarkers of Table 1 or Table 3 from a reference HNSCC BA sample, expression data of the plurality of classifier biomarkers of Table 1 or Table 3 from a reference HNSCC MS sample, expression data of the plurality of classifier biomarkers of Table 1 or Table 3 from a reference HNSCC AT sample, expression data of the plurality of classifier biomarkers of Table 1 or Table 3 from a reference HNSCC CL sample or a combination thereof; and classifying the first sample as BA, MS, AT or CL based on the results of the comparing step. In some cases, the comparing step comprises applying a statistical algorithm which comprises determining a correlation between the expression data obtained from the sample and the expression data from the at least one training set(s); and classifying the sample as a BA, MS, AT or CL subtype based on the results of the statistical algorithm. In some cases, the plurality of the classifier biomarkers comprise each of the classifier biomarkers set forth in Table 1 or Table 3. In some cases, the method further comprises determining the HPV status of the patient. In some cases, the determining the HPV status of the patient comprises measuring the expression of one or more HPV genes in the tissue sample obtained from the patient. In some cases, the one or more HPV genes is the E6 gene, the E7 gene, the E6 and E7 genes or the E6 and E7 genes in combination with one or more additional genes from the HPV genome.

In yet another aspect, provided herein is a method of treating HNSCC in a subject, the method comprising: measuring the expression level of at least one biomarker nucleic acid in a HNSCC sample obtained from the subject, wherein the at least one biomarker nucleic acid is selected from a set of biomarkers listed in Table 1 or Table 3, wherein the presence, absence and/or level of the at least one biomarker indicates a subtype of the HNSCC; and administering an immunotherapeutic agent based on the subtype of the HNSCC. In some cases, the head and neck sample is a HNSCC sample. In some cases, the at least one biomarker nucleic acid selected from the set of biomarkers comprises, consists essentially of or consists of at least two biomarker nucleic acids, at least 18 biomarker nucleic acids, at least 36 biomarker nucleic acids, at least 54 biomarker nucleic acids, at least 72 biomarker nucleic acids, at least 90 biomarker nucleic acids, at least 108 biomarker nucleic acids, at least 126 biomarker nucleic acids, or at least 144 biomarker nucleic acids of Table 1. In some cases, the at least one biomarker nucleic acid selected from the set of biomarkers comprises, consists essentially of or consists of at least two biomarker nucleic acids, at least 10 biomarker nucleic acids, at least 20 biomarker nucleic acids, at least 30 biomarker nucleic acids, at least 40 biomarker nucleic acids, at least 50 biomarker nucleic acids, at least 60 biomarker nucleic acids, at least 70 biomarker nucleic acids, or at least 80 biomarker nucleic acids of Table 3. In some cases, the head and neck tissue sample was previously diagnosed as HNSCC. In some cases, the previous diagnosis was by histological examination. In some cases, the method further comprises measuring the expression of at least one biomarker from an additional set of biomarkers. In some cases, the additional set of biomarkers comprise gene expression signatures of Innate Immune Cells (IIC), Adaptive Immune Cells (AIC), one or more individual immune biomarkers, one or more interferon (IFN) genes, one or more major histocompatibility complex, class II (MHCII) genes or a combination thereof. In some cases, the additional set of biomarkers comprises genes selected from Tables 6A, 6B, 7, 8, 9, or a combination thereof. In some cases, the gene expression signatures of AICs are selected from Table 6A. In some cases, the gene expression signature of IICs are selected from Table 6B. In some cases, the one or more individual immune biomarkers are selected from Table 7. In some cases, one or more IFN genes are selected from Table 8. In some cases, the one or more MHCII genes are selected from Table 9. In some cases, the measuring the expression level is conducted using an amplification, hybridization and/or sequencing assay. In some cases, the amplification, hybridization and/or sequencing assay comprises performing quantitative real time reverse transcriptase polymerase chain reaction (qRT-PCR), RNAseq, microarrays, gene chips, nCounter Gene Expression Assay, Serial Analysis of Gene Expression (SAGE), Rapid Analysis of Gene Expression (RAGE), nuclease protection assays, Northern blotting, or any other equivalent gene expression detection techniques. In some cases, the expression level is detected by performing qRT-PCR. In some cases, the sample is a formalin-fixed, paraffin-embedded (FFPE) head and neck tissue sample, fresh or a frozen tissue sample, an exosome, wash fluids, cell pellets, or a bodily fluid obtained from the patient. In some cases, the bodily fluid is blood or fractions thereof, urine, saliva, or sputum. In some cases, the subject's HNSCC subtype is selected from basal, mesenchymal, atypical or classical. In some cases, the at least one biomarker nucleic acid is a plurality of biomarker nucleic acids, wherein the plurality of biomarker nucleic acids comprises at least one biomarker nucleic acid listed in Table 1 or Table 3 in combination with one or more biomarker nucleic acids from a publically available HNSCC dataset, wherein the presence, absence and/or level of the plurality of biomarker nucleic acids indicates a subtype of the HNSCC. In some cases, the at least one biomarker nucleic acid is a plurality of biomarker nucleic acids, wherein the plurality of biomarker nucleic acids comprises all of the biomarker nucleic acids listed in Table 1 or Table 3 in combination with one or more biomarker nucleic acids from a publically available HNSCC dataset, wherein the presence, absence and/or level of the plurality of biomarker nucleic acids indicates a subtype of the HNSCC. In some cases, the publically available HNSCC dataset is TCGA HNSCC RNAseq dataset. In some cases, the method further comprises determining the HPV status of the patient. In some cases, the determining the HPV status of the patient comprises measuring the expression of one or more HPV genes in the tissue sample obtained from the patient. In some cases, the one or more HPV genes is the E6 gene, the E7 gene, the E6 and E7 genes or the E6 and E7 genes in combination with one or more additional genes from the HPV genome.

BRIEF DESCRIPTION OF THE DRAWINGS

FIG. 3 illustrates the distribution of sample correlation with atypical centroid and silhouette among non-atypical HPV+ samples.

FIG. 4A illustrates survival curves comparing HPV positive atypical to HPV positive non-Atypical tumors in the TCGA dataset with and without adjustment by correlation and silhouette score using the 840 gene gold standard. FIG. 4B illustrates that among non-atypical HPV+ tumors, 3 were atypical-like as measured by correlation with atypical centroid and silhouette. FIG. 4C illustrates survival differences strengthened with adjustment of atypical-like HPV samples using correlation and silhouette. Silhouette* compares distance to the winner centroid vs distance to the atypical centroid. Values near zero mean the sample was almost called atypical. Coxph analysis results agree with logrank test. When adjusted for stage (I-III vs IV) in part FIG. 4C, the survival-group association p-value goes from p=0.026 to p=0.11. HPV+ patients have a lot of missing stage data (28/71 missing).

FIG. 5 illustrates heatmap of immune cells and 30 immune markers across defined HNSCC subtypes (the 144 gene signature plus HPV gene expression) in the TCGA dataset as described in Example 1. Tcm=central memory T cells, Tem=Effector Memory T cells, Th1=Type 1 T helper cells, Th2=Type 2 T helper cells, TFH=T follicular helper cells, Th17=T helper 17 cells, Treg=Tregulatory cells, Tgd=Gamma Delta Tcells.

FIG. 11 illustrates the TCGA datasets, and the other datasets (samples, age, smoking, anatomic site, tumor, node, metastasis (TNM) stage and HPV by gene expression.) used to develop and validate the GeneCentric HNSCC subtyping.

FIG. 12 illustrates the agreement between the reduced gene signature of 144 genes (36 for each of the 4 subtypes) and the gold standard 840 gene signature in the training (TCGA) as well as multiple testing datasets (Keck, von Walter and Wichman) is provided.

FIG. 13 illustrates the evaluation of HPV status versus gold standard subtype and versus 144 gene subtype in TCGA and Keck datasets, using gene expression defined HPV status. Whole genome or E6 gene expression was used in the TCGA dataset and HPV E6 expression was used in the Keck dataset based on available HPV expression data.

FIG. 14 illustrates the agreement of the reduced gene signature of 80 genes (20 for each subtype) with the gold standard 840 gene signature in the training dataset (TCGA) as well as multiple testing datasets Von Walter, Keck, and Wichman is provided.

FIG. 15 illustrates the gold standard subtype agreement with the 80 gene signature and 144 gene signature overall, and by subtype. Gold standard subtype agreement with the 80 gene signature and 144 gene signature overall, and by subtype.

DETAILED DESCRIPTION OF THE INVENTION

Overview

Figure 1:
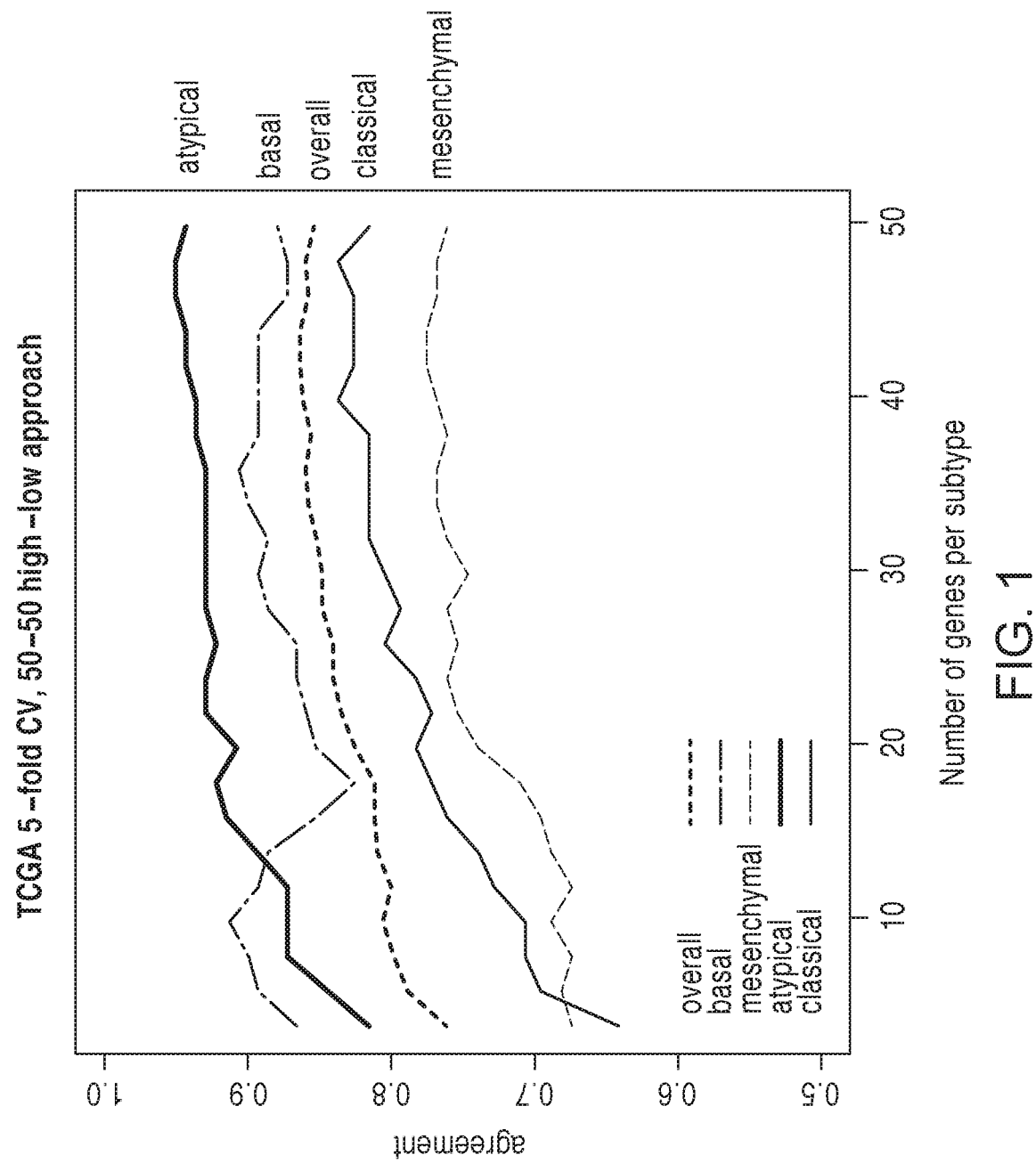
FIG. 1 illustrates five-fold cross validation curves using a Clanc 50:50 high;low approach on the TCGA dataset (n=520) to guide the selection of the number of genes per subtype to include in the signature for HNSCC subtyping provided herein.

The present invention provides kits, compositions and methods for identifying or diagnosing head and neck squamous cell carcinoma or cancer (HNSCC). That is, the methods can be useful for molecularly defining subsets of HNSCC cancer. The kits, compositions and methods can be performed to detect HNSCC in patients that are HPV negative or HPV positive. HPV status of the patient can be determined by detecting expression of HPV related genes and/or protein as described herein. The methods provide a classification of HNSCC that can be prognostic and predictive for therapeutic response. The therapeutic response can include chemotherapy, immunotherapy, surgical intervention and radiotherapy. The methods can be also provide a prognosis with regards to nodal metastasis and overall survival for HNSCC patients according to their HNSCC subtype (e.g., AT, HPV+ AT-like, MS, CL and BA).

While a useful term for epidemiologic purposes, "Head and Neck Squamous Cell Carcinoma" can refer to cancers arising from the oral cavity, oropharynx, nasopharynx, hypopharynx, and larynx. Subtypes of these types of cancer as defined by underlying genomic features can have varied cell of origin, tumor drivers, proliferation, immune responses, and prognosis.

"Determining a HNSCC subtype" can include, for example, diagnosing or detecting the presence and type of HNSCC, monitoring the progression of the disease, and identifying or detecting cells or samples that are indicative of subtypes.

In one embodiment, HNSCC status is assessed through the evaluation of expression patterns, or profiles, of a plurality of classifier genes or biomarkers in one or more subject samples alone or in combination with assessing HPV status. For the purpose of discussion, the term subject, or subject sample, refers to an individual regardless of health and/or disease status. A subject can be a subject, a study participant, a control subject, a screening subject, or any other class of individual from whom a sample is obtained and assessed in the context of the invention. Accordingly, a subject can be diagnosed with HNSCC (including subtypes, or grades thereof), can present with one or more symptoms of HNSCC, or a predisposing factor, such as a family (genetic) or medical history (medical) factor, for HNSCC, can be undergoing treatment or therapy for HNSCC, or the like. Alternatively, a subject can be healthy with respect to any of the aforementioned factors or criteria. It will be appreciated that the term "healthy" as used herein, is relative to HNSCC status, as the term "healthy" cannot be defined to correspond to any absolute evaluation or status. Thus, an individual defined as healthy with reference to any specified disease or disease criterion, can in fact be diagnosed with any other one or more diseases, or exhibit any other one or more disease criterion, including one or more other cancers.

As used herein, an "expression profile" or a "biomarker profile" or "gene signature" comprises one or more values corresponding to a measurement of the relative abundance, level, presence, or absence of expression of a discriminative or classifier gene or biomarker. An expression profile can be derived from a subject prior to or subsequent to a diagnosis of HNSCC, can be derived from a biological sample collected from a subject at one or more time points prior to or following treatment or therapy, can be derived from a biological sample collected from a subject at one or more time points during which there is no treatment or therapy (e.g., to monitor progression of disease or to assess development of disease in a subject diagnosed with or at risk for HNSCC), or can be collected from a healthy subject. The term subject can be used interchangeably with patient. The patient can be a human patient. The one or more biomarkers of the biomarker profiles provided herein are selected from one or more biomarkers of Table 1 or 3.

As used herein, the term "determining an expression level" or "determining an expression profile" or "detecting an expression level" or "detecting an expression profile" as used in reference to a biomarker or classifier means the application of a biomarker specific reagent such as a probe, primer or antibody and/or a method to a sample, for example a sample of the subject or patient and/or a control sample, for ascertaining or measuring quantitatively, semi-quantitatively or qualitatively the amount of a biomarker or biomarkers, for example the amount of biomarker polypeptide or mRNA (or cDNA derived therefrom). For example, a level of a biomarker can be determined by a number of methods including for example immunoassays including for example immunohistochemistry, ELISA, Western blot, immunoprecipitation and the like, where a biomarker detection agent such as an antibody for example, a labeled antibody, specifically binds the biomarker and permits for example relative or absolute ascertaining of the amount of polypeptide biomarker, hybridization and PCR protocols where a probe or primer or primer set are used to ascertain the amount of nucleic acid biomarker, including for example probe based and amplification based methods including for example microarray analysis, RT-PCR such as quantitative RT-PCR (qRT-PCR), serial analysis of gene expression (SAGE), Northern Blot, digital molecular barcoding technology, for example Nanostring Counter Analysis, and TaqMan quantitative PCR assays. Other methods of mRNA detection and quantification can be applied, such as mRNA in situ hybridization in formalin-fixed, paraffin-embedded (FFPE) tissue samples or cells. This technology is currently offered by the QuantiGene ViewRNA (Affymetrix), which uses probe sets for each mRNA that bind specifically to an amplification system to amplify the hybridization signals; these amplified signals can be visualized using a standard fluorescence microscope or imaging system. This system for example can detect and measure transcript levels in heterogeneous samples; for example, if a sample has normal and tumor cells present in the same tissue section. As mentioned, TaqMan probe-based gene expression analysis (PCR-based) can also be used for measuring gene expression levels in tissue samples, and this technology has been shown to be useful for measuring mRNA levels in FFPE samples. In brief, TaqMan probe-based assays utilize a probe that hybridizes specifically to the mRNA target. This probe contains a quencher dye and a reporter dye (fluorescent molecule) attached to each end, and fluorescence is emitted only when specific hybridization to the mRNA target occurs. During the amplification step, the exonuclease activity of the polymerase enzyme causes the quencher and the reporter dyes to be detached from the probe, and fluorescence emission can occur. This fluorescence emission is recorded and signals are measured by a detection system; these signal intensities are used to calculate the abundance of a given transcript (gene expression) in a sample.

In one embodiment, the "expression profile" or a "biomarker profile" or "gene signature" associated with the gene cassettes or classifier genes described herein (e.g., Tables 1 and 3) can be useful for distinguishing between normal and tumor samples. In another embodiment, the tumor samples are Head and Neck Squamous Cell Carcinoma (HNSCC). In another embodiment, HNSCC can be further classified as atypical (AT), basal (BA), classical (CL) and mesenchymal (MS) based upon an expression profile determined using the methods provided herein. In still another embodiment, the expression of HPV genes is determined in the HNSCC sample in order to ascertain the HPV status. The HPV status can be determined prior to, in parallel or after classifying the subtype of HNSCC using the gene signatures presented herein. Expression profiles using the classifier genes disclosed herein (e.g., Table 1 or Table 3) can provide valuable molecular tools for specifically identifying HNSCC subtypes, and for evaluating therapeutic efficacy in treating HNSCC. Accordingly, the invention provides methods for screening and classifying a subject for molecular HNSCC subtypes and methods for monitoring efficacy of certain therapeutic treatments for HNSCC.

In some instances, a single classifier gene provided herein is capable of identifying subtypes of HNSCC with a predictive success of at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, up to 100%.

In some instances, a single classifier gene as provided herein is capable of determining HNSCC subtypes with a sensitivity or specificity of at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, up to 100%.

The present invention also encompasses a system capable of distinguishing various subtypes of HNSCC not detectable using current methods. This system can be capable of processing a large number of subjects and subject variables such as expression profiles and other diagnostic criteria. The methods described herein can also be used for "pharmacometabonomics," in analogy to pharmacogenomics, e.g., predictive of response to therapy. In this embodiment, subjects could be divided into "responders" and "nonresponders" using the expression profile as evidence of "response," and features of the expression profile could then be used to target future subjects who would likely respond to a particular therapeutic course.

The expression profile can be used in combination with other diagnostic methods including histochemical, immunohistochemical, cytologic, immunocytologic, and visual diagnostic methods including histologic or morphometric evaluation of head and neck tissue.

In various embodiments of the present invention, the expression profile derived from a subject is compared to a reference expression profile. A "reference expression profile" or "control expression profile" can be a profile derived from the subject prior to treatment or therapy; can be a profile produced from the subject sample at a particular time point (usually prior to or following treatment or therapy, but can also include a particular time point prior to or following diagnosis of HNSCC); or can be derived from a healthy individual or a pooled reference from healthy individuals. A reference expression profile can be generic for HNSCC or can be specific to different subtypes of HNSCC. The HNSCC reference expression profile can be from the oral cavity, oropharynx, nasopharynx, hypopharynx, larynx or any combination thereof.

The reference expression profile can be compared to a test expression profile. A "test expression profile" can be derived from the same subject as the reference expression profile except at a subsequent time point (e.g., one or more days, weeks or months following collection of the reference expression profile) or can be derived from a different subject. In summary, any test expression profile of a subject can be compared to a previously collected profile from a subject that has a AT, MS, BL or CL HNSCC subtype. The previously collected profile can be HPV positive or negative.

The classifier biomarkers of the invention can include nucleic acids (RNA, cDNA, and DNA) and proteins, and variants and fragments thereof. Such biomarkers can include DNA comprising the entire or partial sequence of the nucleic acid sequence encoding the biomarker, or the complement of such a sequence. The biomarkers described herein can include RNA comprising the entire or partial sequence of any of the nucleic acid sequences of interest, or their non-natural cDNA products, obtained synthetically in vitro in a reverse transcription reaction. The biomarker nucleic acids can also include any expression product or portion thereof of the nucleic acid sequences of interest. A biomarker protein can be a protein encoded by or corresponding to a DNA biomarker of the invention. A biomarker protein can comprise the entire or partial amino acid sequence of any of the biomarker proteins or polypeptides. The biomarker nucleic acid can be extracted from a cell or can be cell free or extracted from an extracellular vesicular entity such as an exosome.

A "classifier biomarker" or "biomarker" or "classifier gene" can be any gene or protein whose level of expression in a tissue or cell is altered compared to that of a normal or healthy cell or tissue. For example, a "classifier biomarker" or "biomarker" or "classifier gene" can be any gene or protein whose level of expression in a tissue or cell is altered in a specific HNSCC subtype. The detection of the biomarkers of the invention can permit the determination of the specific subtype. The "classifier biomarker" or "biomarker" or "classifier gene" may be one that is up-regulated (e.g. expression is increased) or down-regulated (e.g. expression is decreased) relative to a reference or control as provided herein. The reference or control can be any reference or control as provided herein. In some embodiments, the expression values of genes that are up-regulated or down-regulated in a particular subtype of HNSCC can be pooled into one gene cassette. The overall expression level in each gene cassette is referred to herein as the "expression profile" and is used to classify a test sample according to the subtype of HNSCC. However, it is understood that independent evaluation of expression for each of the genes disclosed herein can be used to classify tumor subtypes without the need to group up-regulated and down-regulated genes into one or more gene cassettes. In some cases, as shown in Table 2, a total of 144 biomarkers can be used for HNSCC subtype determination. For each HNSCC subtype, 18 of the 36 biomarkers can be negatively correlated genes while 18 can be positively correlated genes which can be selected as the gene signature of a specific HNSCC subtype. In some cases, as shown in Table 4, a total of 80 biomarkers can be used for HNSCC subtype determination. For each HNSCC subtype, 10 of the 20 biomarkers can be negatively correlated genes while 10 can be positively correlated genes which can be selected as the gene signature of a specific HNSCC subtype.

The classifier biomarkers of the invention include any gene or protein that is selectively expressed in HNSCC, as defined herein above. Sample biomarker genes are listed in Tables 1-4, below. In Table 2 or Table 4, the first column of the table represents the biomarker list selected for distinguishing atypical (AT). The second column of the table represents the biomarker list selected for distinguishing Mesenchymal (MS). The third column of the table represents the biomarker list selected for distinguishing classical (CL). The last column of the table represents the biomarker list selected for distinguishing basal (BA).

The relative gene expression levels as represented by the tsat as described herein of the classifier biomarkers for HNSCC subtyping are shown in Table 1. In one embodiment, the gene expression levels (i.e., T-statistics) of the classifier biomarkers for HNSCC subtyping are shown in Table 1. In one embodiment, all 144 genes of Table 1 can be used to classify the subtypes of HNSCC. In one embodiment, the first 36 genes are the selected gene signature biomarkers for Basal (BA), with gene numbers 1-18 up-regulated and gene numbers 19-36 down-regulated compared to a non-BA sample. In another embodiment, gene numbers 37-72 are the selected gene signature biomarkers specific for Mesenchymal (MS), with gene numbers 37-55 up-regulated and gene numbers 56-72 down-regulated compared to a non-MS sample. In yet another embodiment, gene numbers 73-108 are the selected gene signature biomarkers specific for Atypical (AT), with gene numbers 73-90 up-regulated and gene numbers 91-108 down-regulated compared to a non-AT sample. In still another embodiment, gene numbers 109-144 are the selected gene signature biomarkers specific for Classical (CL), with gene numbers 109-126 up-regulated and gene numbers 127-144 down-regulated compared to a non-CL sample.

TABLE 1

Gene Centroids of 144 Classifier Biomarkers for the Head & Neck Squamous Cell Carcinoma (HNSCC) Subtypes

| Gene Symbol | Gene Name | Atypical (AT) | Mesenchymal (MS) | Classical (CL) | Basal (BL) | GenBank Accession Number* | SEQ ID NO: |
|---|---|---|---|---|---|---|---|
| ABCC1 | ATP binding cassette subfamily C member 1 | −2.082462349 | −6.056787955 | 14.59888581 | −4.393196801 | NM_004996 | 1 |
| ABCC5 | ATP binding cassette subfamily C member 5 | 6.735673492 | −6.863599358 | 13.37272019 | −11.24755644 | NM_005688 | 2 |
| ACTN1 | actinin alpha 1 | −15.80447651 | 9.780116364 | −2.540362155 | 8.160936953 | NM_001130004 | 3 |
| ACTR1A | ARP1 actin related protein 1 homolog A | −7.43029722 | 5.851180405 | −10.40965677 | 10.4118965 | NM_005736 | 4 |
| ADCY10 | adenylate cyclase 10 | −0.716636613 | −1.221986421 | 12.76526279 | −8.904177745 | NM_018417 | 5 |
| AKR1C1 | aldo-keto reductase family 1 member C1 | −1.10933351 | −6.291183618 | 12.40184171 | −3.263102998 | NM_001353 | 6 |
| APBB2 | amyloid beta precursor protein binding family B member 2 | −15.01146625 | 12.44403993 | −3.898903276 | 5.930295847 | NM_004307 | 7 |
| APOL3 | apolipoprotein L3 | 2.286291323 | 5.440122405 | −11.35875857 | 2.052558416 | NM_014349 | 8 |
| AQP3 | aquaporin 3 | 3.750713938 | −5.715868054 | −11.04600183 | 11.23366375 | NM_004925 | 9 |
| ATP13A4 | ATPase 13A4 | 12.01816284 | −12.34716568 | 1.995296458 | −1.467805824 | NM_032279 | 10 |
| ATP6V1D | ATPase H+ transporting V1 subunit D | −7.52217377 | −0.516445247 | −7.608420636 | 14.34606418 | NM_015994 | 11 |
| C16orf57 | U6 snRNA biogenesis phosphodiesterase 1 | −13.73713236 | 5.333139172 | −2.658346322 | 10.56578203 | NM_024598 | 12 |
| C6orf168 | failed axon connections homolog | 6.916821415 | −3.918221166 | 12.70167928 | −13.73240719 | NM_032511 | 13 |
| CAB39 | calcium binding protein 39 | −5.824036851 | 0.858140491 | −9.792409733 | 13.18131087 | NM_016289 | 14 |
| CABYR | calcium binding tyrosine phosphorylation regulated | −0.879225603 | −0.139933807 | 13.33042096 | −10.27836496 | NM_012189 | 15 |
| CALD1 | caldesmon 1 | −13.57155338 | 14.00571674 | −0.997301758 | 0.533651105 | NM_033138 | 16 |
| CASP4 | caspase 4 | −6.233121399 | 1.302626733 | −11.00541654 | 14.1766376 | NM_001225 | 17 |
| CAV1 | caveolin 1 | −13.83491768 | 7.418519883 | −3.94809826 | 9.71830341 | NM_001753 | 18 |
| CD276 | CD276 molecule | −13.57242716 | 10.95369333 | 1.01404026 | 1.810966974 | NM_001024736 | 19 |
| CD74 | CD74 molecule | 5.84959342 | 7.771329118 | −10.50803194 | −4.449565802 | NM_001025159 | 20 |
| CDSN | corneodesmosin | −10.6365512 | −1.493069449 | −4.906096366 | 16.077773 | NM_001264 | 21 |
| CEACAM5 | carcinoembryonic antigen related cell adhesion molecule 5 | 11.35567594 | −11.26562383 | 0.422805332 | −0.540569935 | NM_004363 | 22 |
| CHPT1 | choline phosphotransferase 1 | 9.816276839 | 2.262831082 | 4.328822728 | −15.5331284 | NM_020244 | 23 |
| CHST7 | carbohydrate sulfotransferase 7 | 1.127395223 | −1.274663652 | 13.63700234 | −11.40544572 | NM_019886 | 24 |
| CIITA | class II major histocompatibility complex transactivator | 7.849953146 | 5.449974972 | −11.0739908 | −3.674106625 | NM_001286402 | 25 |
| CLCN2 | chloride voltage-gated channel 2 | 1.869955841 | −3.034672968 | 12.48578206 | −9.444551535 | NM_004366 | 26 |
| CMTM3 | CKLF like MARVEL transmembrane domain containing 3 | −6.94786756 | 14.99532869 | −1.596971364 | −6.444079867 | NM_144601 | 27 |
| COCH | cochlin | 7.245471303 | −2.225717996 | 11.06208646 | −14.32016052 | NM_001135058 | 28 |
| COL6A1 | collagen type VI alpha 1 chain | −10.61945956 | 15.09999138 | 0.023929886 | −4.304047285 | NM_001848 | 29 |
| COL6A2 | collagen type VI alpha 2 chain | −9.816813759 | 15.40019653 | −0.059414969 | −5.31650074 | NM_001849 | 30 |
| CREB3L4 | cAMP responsive element binding protein 3 like 4 | 12.35426247 | −1.036014582 | 4.170449139 | −14.67779961 | NM_130898 | 31 |
| CSNK1A1 | casein kinase 1 alpha 1 | −4.157095083 | −4.379943874 | −6.408502727 | 13.78896776 | NM_001025105 | 32 |
| CSTA | cystatin A | 7.6349338 | −13.92125741 | −4.634101181 | 9.992427797 | NM_005213 | 33 |
| CSTB | cystatin B | 5.441142897 | −10.92489787 | −5.097693335 | 9.619831396 | NM_000100 | 34 |
| CYP26A1 | cytochrome P450 family 26 subfamily A member 1 | 5.568513158 | −4.690925538 | 14.07156336 | −12.8104492 | NM_000783 | 35 |
| CYP4B1 | cytochrome P450 family 4 subfamily B member 1 | 14.45700653 | −7.05416422 | −4.703606141 | −3.36503105 | NM_001099772 | 36 |

TABLE 1-continued

Gene Centroids of 144 Classifier Biomarkers for the Head & Neck Squamous Cell Carcinoma (HNSCC) Subtypes

| Gene Symbol | Gene Name | Atypical (AT) | Mesenchymal (MS) | Classical (CL) | Basal (BL) | GenBank Accession Number* | SEQ ID NO: |
|---|---|---|---|---|---|---|---|
| DHRS1 | dehydrogenase/reductase 1 | −0.193215811 | −6.493438067 | −9.311117789 | 14.40626466 | NM_001136050 | 37 |
| DSG1 | desmoglein 1 | −7.614095504 | −3.451410234 | −3.737838114 | 14.0254529 | NM_001942 | 38 |
| ELF3 | E74 like ETS transcription factor 3 | 13.68731232 | −13.60589315 | 4.343709261 | −3.869532938 | NM_004433 | 39 |
| EPCAM | epithelial cell adhesion molecule | 4.265932752 | −6.736175943 | 13.73306161 | −9.245971416 | NM_002354 | 40 |
| EPGN | epithelial mitogen | −5.618779265 | −3.300485871 | −6.577764094 | 14.31742891 | NM_001270989 | 41 |
| EYA2 | EYA transcriptional coactivator and phosphatase 2 | 15.04545577 | −2.190930112 | 1.591800862 | −14.01747204 | NM_005244 | 42 |
| F2RL1 | F2R like trypsin receptor 1 | −13.80547895 | 2.765020504 | 1.370242141 | 9.730255475 | NM_005242 | 43 |
| FAM171A1 | family with sequence similarity 171 member A1 | 9.195667146 | 2.45871035 | 3.837122752 | −14.69736658 | NM_001010924 | 44 |
| FAM3B | family with sequence similarity 3 member B | 23.49686554 | −10.23769328 | 1.726344969 | −14.59685293 | NM_058186 | 45 |
| FAM40A | striatin interacting protein 1 | 0.072030977 | −1.193725622 | −11.40053476 | 10.74128539 | NM_033088 | 46 |
| FBLIM1 | filamin binding LIM protein 1 | −13.8444937 | 3.484519683 | −5.129731741 | 14.56682766 | NM_017556 | 47 |
| FGD2 | FYVE, RhoGEF and PH domain containing 2 | 6.075397444 | 5.847611036 | −10.21140803 | −3.045464114 | NM_173558 | 48 |
| FKBP9 | FK506 binding protein 9 | −13.43106274 | 7.315547198 | 4.438931756 | 2.324123909 | NM_007270 | 49 |
| FN1 | fibronectin 1 | −10.72721251 | 14.68092168 | 1.901951252 | −5.378217455 | NM_212482 | 50 |
| FOXA1 | forkhead box A1 | 17.64133076 | −11.07111965 | 6.438446491 | −12.00758435 | NM_004496 | 51 |
| FSTL3 | follistatin like 3 | −15.00524247 | 9.744960025 | −2.21225958 | 7.130950667 | NM_005860 | 52 |
| FUT6 | fucosyltransferase 6 | 16.26859049 | −12.17798039 | −2.993362909 | −1.594985757 | NM_000150 | 53 |
| GALNT6 | polypeptide N-acetyl galactosaminyltransferase 6 | −13.07407145 | 2.051509658 | −3.432309832 | 13.77063593 | NM_007210 | 54 |
| GCNT2 | glucosaminyl (N-acetyl) transferase 2, I-branching enzyme (I blood group) | 11.00945937 | −5.005886796 | 12.29522358 | −16.35521859 | NM_145649 | 55 |
| GLS2 | glutaminase 2 | 15.18663893 | −8.147146843 | 8.499138056 | −14.18880539 | NM_013267 | 56 |
| GPR110 | G-protein coupled receptor GPR110 | 12.7116071 | −11.65119722 | −3.963069483 | 2.212488501 | AY140952 | 57 |
| GPRC5B | G protein-coupled receptor class C group 5 member B | 5.833385675 | 5.048036921 | 4.465010876 | −14.44626312 | NM_016235 | 58 |
| GPX8 | glutathione peroxidase 8 (putative) | −10.3612256 | 14.94672566 | 0.015638923 | −4.401628144 | NM_001008397 | 59 |
| GRHL3 | grainyhead like transcription factor 3 | 7.100258671 | −14.0190496 | −0.688942122 | 7.275695546 | NM_021180 | 60 |
| GSDMA | gasdermin A | −9.15951728 | −1.729489137 | −5.968036589 | 15.75333543 | NM_178171 | 61 |
| HEY1 | hes related family bHLH transcription factor with YRPW motif 1 | 0.159448658 | 3.534415289 | 12.27328877 | −13.99193179 | NM_012258 | 62 |
| HLA-DRA | HLA-DRA | 5.635788952 | 7.540528354 | −10.23102672 | −4.248292697 | KY497357 | 63 |
| HLF | HLF, PAR bZIP transcription factor | 16.77558527 | −10.04027801 | 4.574705233 | −10.58434418 | NM_002126 | 64 |
| IKZF2 | IKAROS family zinc finger 2 | 14.98317462 | −6.074474772 | −3.858000118 | −5.554553773 | NM_016260 | 65 |
| IL4R | interleukin 4 receptor | 0.217776544 | 0.457253449 | −13.81453534 | 11.02939058 | NM_000418 | 66 |
| INHBA | inhibin beta A subunit | −14.79489264 | 8.427676625 | −0.696922701 | 6.927158767 | NM_002192 | 67 |
| KIAA1609 | KIAA1609 | −9.8340117 | 2.292555067 | −8.206314175 | 14.38614729 | AB046829 | 68 |
| KLF5 | Kruppel like factor 5 | 4.562842302 | −13.00491807 | 3.89026837 | 4.908510892 | NM_001730 | 69 |
| LEPRE1 | prolyl 3-hydroxylase 1 | −11.83578491 | 16.04587546 | 0.555964732 | −4.480170241 | NM_022356 | 70 |
| LMO4 | LIM domain only 4 | 14.78188317 | −4.286105968 | 2.544496006 | −12.51954481 | NM_006769 | 71 |
| LOC643008 | small integral membrane protein 5 | 12.65412229 | −11.504798 | −3.985040113 | 2.144789085 | XM_017024943 | 72 |
| LRIG1 | leucine rich repeats and immunoglobulin like domains 1 | 6.317083957 | 2.548224024 | 6.751703803 | −14.41779751 | NM_015541 | 73 |
| LTBP3 | latent transforming growth factor beta binding protein 3 | 3.235488698 | 7.629013681 | 6.180250436 | −15.85948808 | NM_001130144 | 74 |
| MAL2 | mal, T-cell differentiation protein 2 | 6.413419457 | −11.71334434 | −0.431651323 | 5.483862841 | NM_052886 | 75 |
| MAP7D1 | MAP7 domain containing 1 | −8.910849678 | 3.124678656 | −10.08235276 | 14.25296762 | NM_018067 | 76 |
| MEIS1 | Meis homeobox 1 | 17.32037654 | −5.648950707 | −2.757291231 | −9.201660614 | NM_002398 | 77 |
| MMP1 | matrix metallopeptidase 1 | −13.26866191 | 6.822304749 | −2.002155679 | 8.096135704 | NM_002421 | 78 |

TABLE 1-continued

Gene Centroids of 144 Classifier Biomarkers for the Head & Neck Squamous Cell Carcinoma (HNSCC) Subtypes

| Gene Symbol | Gene Name | Atypical (AT) | Mesenchymal (MS) | Classical (CL) | Basal (BL) | GenBank Accession Number* | SEQ ID NO: |
|---|---|---|---|---|---|---|---|
| MOBKL2B | MOB kinase activator 3B | −2.913703778 | 4.221634948 | −11.2899732 | 8.301609003 | NM_024761 | 79 |
| MPPED1 | metallophosphoesterase domain containing 1 | 0.75117262 | −3.628778766 | 12.92063032 | −8.131564761 | NM_001044370 | 80 |
| MRAP2 | melanocortin 2 receptor accessory protein 2 | 8.821566644 | −4.975238292 | 12.75983052 | −14.62483234 | NM_138409 | 81 |
| MUC20 | mucin 20, cell surface associated | 15.44317871 | −10.50413061 | 2.271620266 | −6.871349665 | NM_001282506 | 82 |
| MUC4 | mucin 4, cell surface associated | 15.96069019 | −8.652630447 | 2.582388666 | −9.450568232 | NM_018406 | 83 |
| MYB | MYB proto-oncogene, transcription factor | 15.0257076 | −5.385618207 | 5.6522876 | −14.3163554 | NM_001130173 | 84 |
| NNMT | nicotinamide N-methyltransferase | −10.09900408 | 15.95020532 | −3.274573382 | −2.854813073 | NM_006169 | 85 |
| NSUN7 | NOP2/Sun RNA methyltransferase family member 7 | 16.08489314 | −4.722807369 | 6.335643561 | −16.58396549 | NM_024677 | 86 |
| NTRK2 | neurotrophic receptor tyrosine kinase 2 | 10.23093315 | −6.376330063 | 12.76453966 | −14.64867156 | NM_006180 | 87 |
| OLFML2B | olfactomedin like 2B | −6.80300319 | 15.66852662 | −0.83099608 | −7.891812186 | NM_001297713 | 88 |
| OLFML3 | olfactomedin like 3 | −6.546734956 | 16.36834609 | −3.370305787 | −6.678215459 | NM_020190 | 89 |
| P4HTM | prolyl 4-hydroxylase, transmembrane | 11.8274774 | 2.672495061 | 5.253671456 | −18.69507373 | NM_177939 | 90 |
| PAQR5 | progestin and adipoQ receptor family member 5 | −10.21974925 | −0.676386205 | −2.846883938 | 13.12800887 | NM_001104554 | 91 |
| PATZ1 | POZ/BTB and AT hook containing zinc finger 1 | 8.493850484 | 2.966225133 | 7.456620531 | −17.56473037 | NM_014323 | 92 |
| PBX1 | PBX homeobox 1 | 13.2718934 | −1.583812326 | 4.352097293 | −15.20010123 | NM_002585 | 93 |
| PCOLCE | procollagen C-endopeptidase enhancer | −8.027597076 | 16.0810449 | 0.683124494 | −8.370334 | NM_002593 | 94 |
| PHLDB1 | pleckstrin homology like domain family B member 1 | −11.25408443 | 15.15862534 | −1.738679371 | −2.245099413 | NM_015157 | 95 |
| PIR | pirin | 7.490180987 | −9.475330645 | 13.12744434 | −9.233843088 | NM_003662 | 96 |
| PKP3 | plakophilin 3 | −5.164891557 | −4.425600449 | −5.236735217 | 13.83389626 | NM_007183 | 97 |
| PLAC8 | placenta specific 8 | 16.72602757 | −4.212412233 | 1.082753487 | −13.26806322 | NM_001130716 | 98 |
| PLD2 | phospholipase D2 | −4.518197205 | −5.092960256 | −7.348969116 | 15.63604839 | NM_002663 | 99 |
| PMP22 | peripheral myelin protein 22 | −7.194357544 | 14.68864942 | 1.396604647 | −8.43537032 | NM_000304 | 100 |
| PPARD | peroxisome proliferator activated receptor delta | −7.071754506 | −3.884764304 | −4.912078226 | 14.90821141 | NM_006238 | 101 |
| PPL | periplakin | 6.261655734 | −12.16995239 | −1.756388798 | 7.199844946 | NM_002705 | 102 |
| PRKX | protein kinase, X-linked | 8.851366302 | −8.998241561 | 13.1773563 | −11.08142743 | NM_005044 | 103 |
| PRSS27 | protease, serine 27 | 9.329134265 | −10.80925456 | −5.741713479 | 6.225164659 | NM_031948 | 104 |
| PTH1R | parathyroid hormone 1 receptor | −6.722598413 | 14.82555669 | −0.472460255 | −7.45169274 | NM_000316 | 105 |
| PTRF | caveolae associated protein 1 | −13.14332726 | 9.468944832 | −4.638965523 | 7.621207859 | NM_012232 | 106 |
| RAB25 | RAB25, member RAS oncogene family | 5.219572333 | −11.52664115 | −0.156829226 | 6.244155734 | NM_020387 | 107 |
| RAB6B | RAB6B, member RAS oncogene family | −1.603161781 | 0.110021996 | 15.94132967 | −12.01912932 | NM_016577 | 108 |
| RCN3 | reticulocalbin 3 | −8.161767875 | 14.46620853 | 1.654069744 | −7.483978219 | NM_020650 | 109 |
| RFTN1 | raftlin, lipid raft linker 1 | −4.573623438 | 9.589915176 | −10.67106662 | 4.172768882 | NM_015150 | 110 |
| RGS20 | regulator of G protein signaling 20 | −12.52290526 | 2.810238619 | −4.159943794 | 13.1034325 | NM_170587 | 111 |
| RIMKLA | ribosomal modification protein rimK like family member A | 7.013215205 | −3.910313002 | 13.32678642 | −14.36397185 | NM_173642 | 112 |
| SCARA3 | scavenger receptor class A member 3 | 8.486922621 | 2.228910754 | 4.488976365 | −14.32712171 | NM_016240 | 113 |
| SCNN1A | sodium channel epithelial 1 alpha subunit | 9.314590424 | −10.85586757 | 4.480301787 | −2.364983519 | NM_001038 | 114 |
| SERPINE1 | serpin family E member 1 | −14.50591442 | 8.635050854 | 1.480793338 | 4.597552116 | NM_000602 | 115 |
| SERPINH1 | serpin family H member 1 | −14.74205489 | 14.20433013 | 0.878953362 | −0.095802953 | NM_001207014 | 116 |
| SETMAR | SET domain and mariner transposase fusion gene | 12.83440944 | 0.233932813 | 2.138469148 | −14.67025168 | NM_006515 | 117 |
| SFXN3 | sideroflexin 3 | −13.93133999 | 11.56847653 | −6.74034327 | 8.126085326 | NM_030971 | 118 |
| SGEF | SH3-containing guanine nucleotide exchange factor | 15.50488845 | −8.827171693 | 14.7491026 | −19.12717961 | AY552599 | 119 |
| SH2D4A | SH2 domain containing 4A | 14.91939392 | −10.45712779 | −1.285782521 | −3.391377233 | NM_022071 | 120 |

TABLE 1-continued

Gene Centroids of 144 Classifier Biomarkers for the Head & Neck Squamous Cell Carcinoma (HNSCC) Subtypes

| Gene Symbol | Gene Name | Atypical (AT) | Mesenchymal (MS) | Classical (CL) | Basal (BL) | GenBank Accession Number* | SEQ ID NO: |
|---|---|---|---|---|---|---|---|
| SH2D5 | SH2 domain containing 5 | −13.29966495 | 1.411309304 | −2.686017395 | 13.9859309 | NM_001103161 | 121 |
| SLAMF7 | SLAM family member 7 | 4.242417997 | 2.960164251 | −10.72277915 | 2.009246005 | NM_021181 | 122 |
| SLC16A14 | solute carrier family 16 member 14 | 8.453385598 | −5.352426361 | 12.76874135 | −13.90188986 | NM_152527 | 123 |
| SLC31A2 | solute carrier family 31 member 2 | −8.009411845 | 6.173856422 | −11.1271606 | 11.27415259 | NM_001860 | 124 |
| SLC9A3R1 | SLC9A3 regulator 1 | 9.971190685 | −12.54044249 | 4.659221949 | −1.518674303 | NM_004252 | 125 |
| SNAI2 | snail family transcriptional repressor 2 | −14.55807791 | 7.947052877 | 0.055367787 | 6.526518445 | NM_003068 | 126 |
| SPARC | secreted protein acidic and cysteine rich | −9.442299973 | 14.5249952 | 0.460899979 | −5.27130454 | NM_003118 | 127 |
| SPINK5 | serine peptidase inhibitor, Kazal type 5 | 8.887143269 | −10.88801305 | −5.380297697 | 6.431225145 | NM_001127698 | 128 |
| TAGLN | transgelin | −8.774403137 | 14.78574024 | 1.128839097 | −6.748363792 | NM_001001522 | 129 |
| TBXA2R | thromboxane A2 receptor | −7.041663263 | 14.43062303 | −1.279759745 | −6.069091489 | NM_001060 | 130 |
| TGFB3 | transforming growth factor beta 3 | −5.513659516 | 14.73938538 | −3.22553509 | −6.227831211 | NM_003239 | 131 |
| TGFBI | transforming growth factor beta induced | −15.54040671 | 11.61576363 | −3.305840607 | 6.757370024 | NM_000358 | 132 |
| TJP3 | tight junction protein 3 | 17.32770506 | −9.778563744 | −1.776083891 | −6.00908976 | NM_001267560 | 133 |
| TMEM51 | transmembrane protein 51 | 2.637524229 | 3.608309483 | −13.856265 | 5.607931398 | NM_001136216 | 134 |
| TMPRSS11A | transmembrane protease, serine 11A | 14.96390452 | −13.07259679 | 1.124526863 | −2.922374221 | NM_182606 | 135 |
| TMPRSS11B | transmembrane protease, serine 11B | 16.17986512 | −11.62554287 | −1.63009884 | −3.200386118 | NM_182502 | 136 |
| TMPRSS2 | transmembrane protease, serine 2 | 19.36438158 | −10.34381575 | 2.078270847 | −10.72366129 | NM_001135099 | 137 |
| TTC9 | tetratricopeptide repeat domain 9 | 11.89329997 | −12.38268834 | −1.756842725 | 1.864848764 | NM_015351 | 138 |
| TXNRD1 | thioredoxin reductase 1 | −0.999104468 | −3.250337096 | 14.50623299 | −8.119912193 | NM_182729 | 139 |
| UBA7 | ubiquitin like modifier activating enzyme 7 | 5.929616343 | 4.581359308 | −11.05993504 | −0.948212309 | NM_003335 | 140 |
| VAMP3 | vesicle associated membrane protein 3 | −3.668365448 | 1.73966571 | −10.63156161 | 10.90939129 | NM_004781 | 141 |
| VAV3 | vav guanine nucleotide exchange factor 3 | 4.420409601 | −0.330479172 | −10.38204488 | 4.757063432 | NM_006113 | 142 |
| VEGFC | vascular endothelial growth factor C | −13.74904145 | 10.29391086 | −8.204386968 | 10.42939104 | NM_005429 | 143 |
| ZDHHC2 | zinc finger DHHC-type containing 2 | 9.037395105 | 0.904115321 | 11.9082815 | −19.85433707 | NM_016353 | 144 |

*Each GenBank Accession Number is a representative or exemplary GenBank Accession Number for the listed gene and is herein incorporated by reference in its entirety for all purposes. Further, each listed representative or exemplary accession number should not be construed to limit the claims to the specific accession number.

TABLE 2

Classifier Biomarkers Selected for AT, MS, BA and CL HNSCC Subtypes

| Number | Atypical (AT) | Mesenchymal (MS) | Classical (CL) | Basal (BA) |
|---|---|---|---|---|
| 1 | ACTN1 | ATP13A4 | ABCC1 | ATP6V1D |
| 2 | APBB2 | CEACAM5 | ABCC5 | CAB39 |
| 3 | C16orf57 | CMTM3 | ACTR1A | CDSN |
| 4 | CALD1 | COL6A1 | ADCY10 | CHPT1 |
| 5 | CAV1 | COL6A2 | AKR1C1 | COCH |
| 6 | CD276 | CSTA | APOL3 | CREB3L4 |
| 7 | CYP4B1 | CSTB | AQP3 | CSNK1A1 |
| 8 | EYA2 | ELF3 | C6orf168 | DHRS1 |
| 9 | F2RL1 | FN1 | CABYR | DSG1 |
| 10 | FAM3B | GPR110 | CASP4 | EPGN |
| 11 | FKBP9 | GPX8 | CD74 | FAM171A1 |
| 12 | FOXA1 | GRHL3 | CHST7 | FBLIM1 |
| 13 | FSTL3 | KLF5 | CIITA | GALNT6 |
| 14 | FUT6 | LEPRE1 | CLCN2 | GCNT2 |
| 15 | GLS2 | LOC643008 | CYP26A1 | GPRC5B |
| 16 | HLF | MAL2 | EPCAM | GSDMA |
| 17 | IKZF2 | NNMT | FAM40A | KIAA1609 |
| 18 | INHBA | OLFML2B | FGD2 | LRIG1 |
| 19 | LMO4 | OLFML3 | HEY1 | LTBP3 |
| 20 | MEIS1 | PCOLCE | HLA-DRA | MAP7D1 |
| 21 | MMP1 | PHLDB1 | IL4R | MRAP2 |
| 22 | MUC20 | PMP22 | MOBKL2B | NSUN7 |
| 23 | MUC4 | PPL | MPPED1 | NTRK2 |
| 24 | MYB | PRSS27 | PIR | P4HTM |
| 25 | PLAC8 | PTH1R | PRKX | PAQR5 |
| 26 | PTRF | RAB25 | RAB6B | PATZ1 |
| 27 | SERPINE1 | RCN3 | RFTN1 | PBX1 |
| 28 | SERPINH1 | SCNN1A | RIMKLA | PKP3 |
| 29 | SFXN3 | SLC9A3R1 | SLAMF7 | PLD2 |
| 30 | SH2D4A | SPARC | SLC16A14 | PPARD |
| 31 | SNAI2 | SPINK5 | SLC31A2 | RGS20 |
| 32 | TGFBI | TAGLN | TMEM51 | SCARA3 |
| 33 | TJP3 | TBXA2R | TXNRD1 | SETMAR |
| 34 | TMPRSS11B | TGFB3 | UBA7 | SGEF |
| 35 | TMPRSS2 | TMPRSS11A | VAMP3 | SH2D5 |
| 36 | VEGFC | TTC9 | VAV3 | ZDHHC2 |

The relative gene expression levels as represented by the tsat as described herein of the classifier biomarkers for HNSCC subtyping are shown in Table 3. In one embodiment, the gene expression levels (i.e., T-statistics) of the classifier biomarkers for HNSCC subtyping are shown in Table 3. In one embodiment, all 80 genes of Table 3 can be used to classify the subtypes of HNSCC. In one embodiment, the first 20 genes are the selected gene signature biomarkers for Basal (BA), with gene numbers 1-10 up-regulated and gene numbers 11-20 down-regulated compared to a non-BA sample. In another embodiment, gene numbers 21-40 are the selected gene signature biomarkers specific for Mesenchymal (MS), with gene numbers 21-30 up-regulated and gene numbers 31-40 down-regulated compared to a non-MS sample. In yet another embodiment, gene numbers 41-60 are the selected gene signature biomarkers specific for Atypical (AT), with gene numbers 41-50 up-regulated and gene numbers 51-60 down-regulated compared to a non-AT sample. In still another embodiment, gene numbers 61-80 are the selected gene signature biomarkers specific for Classical (CL), with gene numbers 61-70 up-regulated and gene numbers 71-80 down-regulated compared to a non-CL sample.

TABLE 3

Gene Centroids of 80 Classifier Biomarkers for the Head & Neck Squamous Cell Carcinoma (HNSCC) Subtypes

| Gene Symbol | Gene Name | Atypical (AT) | Mesenchymal (MS) | Classical (CL) | Basal (BL) | GenBank Accession Number* | SEQ ID NO: |
|---|---|---|---|---|---|---|---|
| ABCC1 | ATP binding cassette subfamily C member 1 | −2.082462 | −6.056787955 | 14.59889 | −4.3932 | NM_004996 | 1 |
| ABCC5 | ATP binding cassette subfamily C member 5 | 6.7356735 | −6.863599358 | 13.37272 | −11.2476 | NM_005688 | 2 |
| ACTN1 | actinin alpha 1 | −15.80448 | 9.780116364 | −2.54036 | 8.160937 | NM_001130004 | 3 |
| APBB2 | amyloid beta precursor protein binding family B member 2 | −15.01147 | 12.44403993 | −3.8989 | 5.930296 | NM_004307 | 7 |
| APOL3 | apolipoprotein L3 | 2.2862913 | 5.440122405 | −11.3588 | 2.052558 | NM_014349 | 8 |
| AQP3 | aquaporin 3 | 3.7507139 | −5.715868054 | −11.046 | 11.23366 | NM_004925 | 9 |
| ATP13A4 | ATPase 13A4 | 12.018163 | −12.34716568 | 1.995296 | −1.46781 | NM_032279 | 10 |
| ATP6V1D | ATPase H+ transporting V1 subunit D | −7.522174 | −0.516445247 | −7.60842 | 14.34606 | NM_015994 | 11 |
| CABYR | calcium binding tyrosine phosphorylation regulated | −0.879226 | −0.139933807 | 13.33042 | −10.2784 | NM_012189 | 15 |
| CASP4 | caspase 4 | −6.233121 | 1.302626733 | −11.0054 | 14.17664 | NM_001225 | 17 |
| CAV1 | caveolin 1 | −13.83492 | 7.418519883 | −3.9481 | 9.718303 | NM_001753 | 18 |
| CDSN | corneodesmosin | −10.63655 | −1.493069449 | −4.9061 | 16.07776 | NM_001264 | 21 |
| CHPT1 | choline phosphotransferase 1 | 9.8162768 | 2.262831082 | 4.328823 | −15.5331 | NM_020244 | 23 |
| CHST7 | carbohydrate sulfotransferase 7 | 1.1273952 | −1.274663652 | 13.637 | −11.4054 | NM_019886 | 24 |
| CIITA | class II major histocompatibility complex transactivator | 7.8499531 | 5.449974972 | −11.074 | −3.67411 | NM_001286402 | 25 |
| CMTM3 | CKLF like MARVEL transmembrane domain containing 3 | −6.947868 | 14.99532869 | −1.59697 | −6.44408 | NM_144601 | 27 |
| COL6A1 | collagen type VI alpha 1 chain | −10.61946 | 15.09999138 | 0.02393 | −4.30405 | NM_001848 | 29 |
| COL6A2 | collagen type VI alpha 2 chain | −9.816814 | 15.40019653 | −0.05941 | −5.3165 | NM_001849 | 30 |
| CSTA | cystatin A | 7.6349338 | −13.92125741 | −4.6341 | 9.992428 | NM_005213 | 33 |
| CYP26A1 | ytochrome P450 family 26 subfamily A member 1 | 5.5685132 | −4.690925538 | 14.07156 | −12.8104 | NM_000783 | 35 |
| DHRS1 | dehydrogenase/reductase 1 | −0.193216 | −6.493438067 | −9.31112 | 14.40626 | NM_001136050 | 37 |
| ELF3 | E74 like ETS transcription factor 3 | 13.687312 | −13.60589315 | 4.343709 | −3.86953 | NM_004433 | 39 |
| EPCAM | epithelial cell adhesion molecule | 4.2659328 | −6.736175943 | 13.73306 | −9.24597 | NM_002354 | 40 |
| EPGN | epithelial mitogen | −5.618779 | −3.300485871 | −6.57776 | 14.31743 | NM_001270989 | 41 |

TABLE 3-continued

Gene Centroids of 80 Classifier Biomarkers for the Head & Neck Squamous Cell Carcinoma (HNSCC) Subtypes

| Gene Symbol | Gene Name | Atypical (AT) | Mesenchymal (MS) | Classical (CL) | Basal (BL) | GenBank Accession Number* | SEQ ID NO: |
|---|---|---|---|---|---|---|---|
| FAM171A1 | family with sequence similarity 171 member A1 | 9.1956671 | 2.45871035 | 3.837123 | −14.6974 | NM_001010924 | 44 |
| FAM3B | family with sequence similarity 3 member B | 23.496866 | −10.23769328 | 1.726345 | −14.5969 | NM_058186 | 45 |
| FAM40A | striatin interacting protein 1 | 0.072031 | −1.193725622 | −11.4005 | 10.74129 | NM_033088 | 46 |
| FBLIM1 | filamin binding LIM protein 1 | −13.84449 | 3.484519683 | −5.12973 | 14.56683 | NM_017556 | 47 |
| FOXA1 | forkhead box A1 | 17.64134 | −11.07111965 | 6.438446 | −12.0076 | NM_004496 | 51 |
| FSTL3 | follistatin like 3 | −15.00524 | 9.744960025 | −2.21226 | 7.130951 | NM_005860 | 52 |
| FUT6 | fucosyltransferase 6 | 16.26859 | −12.17798039 | −2.99336 | −1.59499 | NM_000150 | 53 |
| GCNT2 | glucosaminyl (N-acetyl) transferase 2,I-branching enzyme (I blood group) | 11.009459 | −5.005886796 | 12.29522 | −16.3552 | NM_145649 | 55 |
| GPX8 | glutathione peroxidase 8 (putative) | −10.36123 | 14.94672566 | 0.015639 | −4.40163 | NM_001008397 | 59 |
| GRHL3 | grainyhead like transcription factor 3 | 7.1002587 | −14.0190496 | −0.68894 | 7.275696 | NM_021180 | 60 |
| GSDMA | gasdermin A | −9.159517 | −1.729489137 | −5.96804 | 15.75334 | NM_178171 | 61 |
| HLF | HLF, PAR bZIP transcription factor | 16.775585 | −10.04027801 | 4.574705 | −10.5843 | NM_002126 | 64 |
| IL4R | interleukin 4 receptor | 0.2177765 | 0.457253449 | −13.8145 | 11.02939 | NM_000418 | 66 |
| INHBA | inhibin beta A subunit | −14.79489 | 8.427676625 | −0.69692 | 6.927159 | NM_002192 | 67 |
| KIAA1609 | KIAA1609 | −9.834012 | 2.292555067 | −8.20631 | 14.38615 | AB046829 | 68 |
| KLF5 | Kruppel like factor 5 | 4.5628423 | −13.00491807 | 3.890268 | 4.908511 | NM_001730 | 69 |
| LEPRE1 | prolyl 3-hydroxylase 1 | −11.83578 | 16.04587546 | 0.555965 | −4.48017 | NM_022356 | 70 |
| LTBP3 | latent transforming growth factor beta binding protein 3 | 3.2354887 | 7.629013681 | 6.18025 | −15.8595 | NM_001130144 | 74 |
| MAL2 | mal, T-cell differentiation protein 2 | 6.4134195 | −11.71334434 | −0.43165 | 5.483863 | NM_052886 | 75 |
| MAP7D1 | MAP7 domain containing 1 | −8.91085 | 3.124678656 | −10.0824 | 14.25297 | NM_018067 | 76 |
| MEIS1 | Meis homeobox 1 | 17.320377 | −5.648950707 | −2.75729 | −9.20166 | NM_002398 | 77 |
| MOBKL2B | MOB kinase activator 3B | −2.913704 | 4.221634948 | −11.29 | 8.301609 | NM_024761 | 79 |
| MUC4 | mucin 4, cell surface associated | 15.96069 | −8.652630447 | 2.582389 | −9.45057 | NM_018406 | 83 |
| NNMT | nicotinamide N-methyltransferase | −10.099 | 15.95020532 | −3.27457 | −2.85481 | NM_024677 | 86 |
| NSUN7 | NOP2/Sun RNA methyltransferase family member 7 | 16.084893 | −4.722807369 | 6.335644 | −16.584 | NM_006180 | 87 |
| OLFML2B | olfactomedin like 2B | −6.803003 | 15.66852662 | −0.831 | −7.89181 | NM_001297713 | 88 |
| OLFML3 | olfactomedin like 3 | −6.546735 | 16.36834609 | −3.37031 | −6.67822 | NM_020190 | 89 |
| P4HTM | prolyl 4-hydroxylase, transmembrane | 11.827477 | 2.672495061 | 5.253671 | −18.6951 | NM_177939 | 90 |
| PATZ1 | POZ/BTB and AT hook containing zinc finger 1 | 8.4938505 | 2.966225133 | 7.456621 | −17.5647 | NM_014323 | 92 |

TABLE 3-continued

Gene Centroids of 80 Classifier Biomarkers for the Head & Neck Squamous Cell Carcinoma (HNSCC) Subtypes

| Gene Symbol | Gene Name | Atypical (AT) | Mesenchymal (MS) | Classical (CL) | Basal (BL) | GenBank Accession Number* | SEQ ID NO: |
|---|---|---|---|---|---|---|---|
| PBX1 | PBX homeobox 1 | 13.271893 | −1.583812326 | 4.352097 | −15.2001 | NM_002585 | 93 |
| PCOLCE | procollagen C-endopeptidase enhancer | −8.027597 | 16.0810449 | 0.683124 | −8.37033 | NM_002593 | 94 |
| PHLDB1 | pleckstrin homology like domain family B member 1 | −11.25408 | 15.15862534 | −1.73868 | −2.2451 | NM_015157 | 95 |
| PLAC8 | placenta specific 8 | 16.726028 | −4.212412233 | 1.082753 | −13.2681 | NM_001130716 | 98 |
| PLD2 | phospholipase D2 | −4.518197 | −5.092960256 | −7.34897 | 15.63605 | NM_002663 | 99 |
| PPARD | peroxisome proliferator activated receptor delta | −7.071755 | −3.884764304 | −4.91208 | 14.90821 | NM_006238 | 101 |
| PPL | periplakin | 6.2616557 | −12.16995239 | −1.75639 | 7.199845 | NM_002705 | 102 |
| PRKX | protein kinase, X-linked | 8.8513663 | −8.998241561 | 13.17736 | −11.0814 | NM_005044 | 103 |
| RAB6B | RAB6B, member RAS oncogene family | −1.603162 | 0.110021996 | 15.94133 | −12.0191 | NM_016577 | 108 |
| RIMKLA | ribosomal modification protein rimK like family member A | 7.0132152 | −3.910313002 | 13.32679 | −14.364 | NM_173642 | 112 |
| SERPINE1 | serpin family E member 1 | −14.50591 | 8.635050854 | 1.480793 | 4.597552 | NM_000602 | 115 |
| SERPINH1 | serpin family H member 1 | −14.74205 | 14.20433013 | 0.878953 | −0.0958 | NM_001207014 | 116 |
| SFXN3 | sideroflexin 3 | −13.93134 | 11.56847653 | −6.74034 | 8.126085 | NM_030971 | 118 |
| SGEF | SH3-containing guanine nucleotide exchange factor | 15.504888 | −8.827171693 | 14.7491 | −19.1272 | AY552599 | 119 |
| SLC31A2 | solute carrier family 31 member 2 | −8.009412 | 6.173856422 | −11.1272 | 11.27415 | NM_001860 | 124 |
| SLC9A3R1 | SLC9A3 regulator 1 | 9.9711907 | −12.54044249 | 4.659222 | −1.51867 | NM_004252 | 125 |
| SNAI2 | snail family transcriptional repressor 2 | −14.55808 | 7.947052877 | 0.055368 | 6.526518 | NM_003068 | 126 |
| TGFBI | transforming growth factor beta induced | −15.54041 | 11.61576363 | −3.30584 | 6.75737 | NM_000358 | 132 |
| TJP3 | tight junction protein 3 | 17.327705 | −9.778563744 | −1.77608 | −6.00909 | NM_001267560 | 133 |
| TMEM51 | transmembrane protein 51 | 2.6375242 | 3.608309483 | −13.8563 | 5.607931 | NM_001136216 | 134 |
| TMPRSS11A | transmembrane protease, serine 11A | 14.963905 | −13.07259679 | 1.124527 | −2.92237 | NM_182606 | 135 |
| TMPRSS11B | transmembrane protease, serine 11B | 16.179865 | −11.62554287 | −1.6301 | −3.20039 | NM_182502 | 136 |
| TMPRSS2 | transmembrane protease, serine 2 | 19.364382 | −10.34381575 | 2.078271 | −10.7237 | NM_001135099 | 137 |
| TTC9 | tetratricopeptide repeat domain 9 | 11.8933 | −12.38268834 | −1.75684 | 1.864849 | NM_015351 | 138 |
| TXNRD1 | thioredoxin reductase 1 | −0.999104 | −3.250337096 | 14.50623 | −8.11991 | NM_182729 | 139 |
| UBA7 | ubiquitin like modifier activating enzyme 7 | 5.9296163 | 4.581359308 | −11.0599 | −0.94821 | NM_003335 | 140 |
| ZDHHC2 | zinc finger DHHC-type containing 2 | 9.0373951 | 0.904115321 | 11.90828 | −19.8543 | NM_016353 | 144 |

*Each GenBank Accession Number is a representative or exemplary GenBank Accession Number for the listed gene and is herein incorporated by reference in its entirety for all purposes. Further, each listed representative or exemplary accession number should not be construed to limit the claims to the specific accession number.

TABLE 4

Classifier Biomarkers Selected for
AT, MS, BL and CL HNSCC Subtypes

| Number | Atypical (AT) | Mesenchymal (MS) | Classical (CL) | Basal (BA) |
|---|---|---|---|---|
| 1 | ACTN1 | ATP13A4 | ABCC1 | ATP6V1D |
| 2 | APBB2 | CMTM3 | ABCC5 | CDSN |
| 3 | CAV1 | COL6A1 | APOL3 | CHPT1 |
| 4 | FAM3B | COL6A2 | AQP3 | DHRS1 |
| 5 | FOXA1 | CSTA | CABYR | EPGN |
| 6 | FSTL3 | ELF3 | CASP4 | FAM171A1 |
| 7 | FUT6 | GPX8 | CHST7 | FBLIM1 |
| 8 | HLF | GRHL3 | CIITA | GCNT2 |
| 9 | INHBA | KLF5 | CYP26A1 | GSDMA |
| 10 | MEIS1 | LEPRE1 | EPCAM | KIAA1609 |
| 11 | MUC4 | MAL2 | FAM40A | LTBP3 |
| 12 | PLAC8 | NNMT | IL4R | MAP7D1 |
| 13 | SERPINE1 | OLFML2B | MOBKL2B | NSUN7 |
| 14 | SERPINH1 | OLFML3 | PRKX | P4HTM |
| 15 | SFXN3 | PCOLCE | RAB6B | PATZ1 |
| 16 | SNAI2 | PHLDB1 | RIMKLA | PBX1 |
| 17 | TGFBI | PPL | SLC31A2 | PLD2 |
| 18 | TJP3 | SLC9A3R1 | TMEM51 | PPARD |
| 19 | TMPRSS11B | TMPRSS11A | TXNRD1 | SGEF |
| 20 | TMPRSS2 | TTC9 | UBA7 | ZDHHC2 |

Diagnostic Uses

In one embodiment, the methods and compositions provided herein allow for the differentiation of the four subtypes of HNSCC: (1) Basal (BA); (2) Mesenchymal (MS); (3) Atypical (AT); and (4) Classical (CL), with fewer genes needed than the molecular HNSCC subtyping methods known in the art.

In general, the methods provided herein are used to classify HNSCC sample as a particular HNSCC subtype (e.g. subtype of HNSCC). In one embodiment, the method comprises measuring, detecting or determining an expression level of at least one of the classifier biomarkers of any publically available HNSCC expression dataset. In one embodiment, the method comprises detecting or determining an expression level of at least one of the classifier biomarkers of Table 1 or Table 3 in a HNSCC sample obtained from a patient or a subject. The HNSCC sample for the detection or differentiation methods described herein can be a sample previously determined or diagnosed as squamous cell carcinoma (SCC) sample. The previous diagnosis can be based on a histological analysis. The histological analysis can be performed by one or more pathologists.

In one embodiment, the measuring or detecting step is at the nucleic acid level by performing RNA-seq, a reverse transcriptase polymerase chain reaction (RT-PCR) or a hybridization assay with oligonucleotides that are substantially complementary to portions of cDNA molecules of the at least one classifier biomarker (such as the classifier biomarkers of Table 1 or Table 3) under conditions suitable for RNA-seq, RT-PCR or hybridization and obtaining expression levels of the at least one classifier biomarkers based on the detecting step. The expression levels of the at least one of the classifier biomarkers are then compared to reference expression levels of the at least one of the classifier biomarker (such as the classifier biomarkers of Table 1 or Table 3) from at least one sample training set. The at least one sample training set can comprise, (i) expression levels of the at least one biomarker from a sample that overexpresses the at least one biomarker, (ii) expression levels from a reference BA, MS, AT or CL sample, or (iii) expression levels from SCC free head and neck sample, and classifying the head and neck tissue sample as a BA, MS, AT or CL subtype. The head and neck cancer sample can then be classified as a BA, MS, AT or CL subtype of squamous cell carcinoma based on the results of the comparing step. In one embodiment, the comparing step can comprise applying a statistical algorithm which comprises determining a correlation between the expression data obtained from the head and neck tissue or cancer sample and the expression data from the at least one training set(s); and classifying the head and neck tissue or cancer sample as a BA, MS, AT or CL sample subtype based on the results of the statistical algorithm.

In one embodiment, the method comprises probing the levels of at least one of the classifier biomarkers provided herein, such as the classifier biomarkers of Table 1 or 3 at the nucleic acid level, in a head and neck cancer sample obtained from the patient. The head and neck cancer sample can be a sample previously determined or diagnosed as a squamous cell carcinoma (SCC or SQ) sample. The previous diagnosis can be based on a histological analysis. The histological analysis can be performed by one or more pathologists. The probing step, in one embodiment, comprises mixing the sample with one or more oligonucleotides that are substantially complementary to portions of cDNA molecules of the at least one classifier biomarkers provided herein, such as the classifier biomarkers of Table 1 or 3 under conditions suitable for hybridization of the one or more oligonucleotides to their complements or substantial complements; detecting whether hybridization occurs between the one or more oligonucleotides to their complements or substantial complements; and obtaining hybridization values of the at least one classifier biomarkers based on the detecting step. The hybridization values of the at least one classifier biomarkers are then compared to reference hybridization value(s) from at least one sample training set. For example, the at least one sample training set comprises hybridization values from a reference BA SCC, MS SCC AT SCC, and/or CL SCC sample. The head and neck cancer sample is classified, for example, as BA, MS, AT or CL based on the results of the comparing step.

The head and neck tissue sample can be any sample isolated from a human subject or patient. For example, in one embodiment, the analysis is performed on head and neck biopsies that are embedded in paraffin wax. In one embodiment, the sample can be a fresh frozen head and neck tissue sample. In another embodiment, the sample can be a bodily fluid obtained from the patient. The bodily fluid can be blood or fractions thereof (i.e., serum, plasma), urine, saliva, sputum or cerebrospinal fluid (CSF). The sample can contain cellular as well as extracellular sources of nucleic acid for use in the methods provided herein. The extracellular sources can be cell-free DNA and/or exosomes. In one embodiment, the sample can be a cell pellet or a wash. This aspect of the invention provides a means to improve current diagnostics by accurately identifying the major histological types, even from small biopsies. The methods of the invention, including the RT-PCR methods, are sensitive, precise and have multi-analyte capability for use with paraffin embedded samples. See, for example, Cronin et al. (2004) Am. J Pathol. 164(1):35-42, herein incorporated by reference.

Formalin fixation and tissue embedding in paraffin wax is a universal approach for tissue processing prior to light microscopic evaluation. A major advantage afforded by formalin-fixed paraffin-embedded (FFPE) specimens is the preservation of cellular and architectural morphologic detail in tissue sections. (Fox et al. (1985) J Histochem Cytochem 33:845-853). The standard buffered formalin fixative in which biopsy specimens are processed is typically an aqueous solution containing 37% formaldehyde and 10-15% methyl alcohol. Formaldehyde is a highly reactive dipolar compound that results in the formation of protein-nucleic acid and protein-protein crosslinks in vitro (Clark et al. (1986) J Histochem Cytochem 34:1509-1512; McGhee and von Hippel (1975) Biochemistry 14:1281-1296, each incorporated by reference herein).

In one embodiment, the sample used herein is obtained from an individual, and comprises formalin-fixed paraffin-embedded (FFPE) tissue. However, other tissue and sample types are amenable for use herein. In one embodiment, the other tissue and sample types can be fresh frozen tissue, wash fluids, or cell pellets, or the like. In one embodiment, the sample can be a bodily fluid obtained from the individual. The bodily fluid can be blood or fractions thereof (e.g., serum, plasma), urine, sputum, saliva or cerebrospinal fluid (CSF). A biomarker nucleic acid as provided herein can be extracted from a cell or can be cell free or extracted from an extracellular vesicular entity such as an exosome.

Methods are known in the art for the isolation of RNA from FFPE tissue. In one embodiment, total RNA can be isolated from FFPE tissues as described by Bibikova et al. (2004) American Journal of Pathology 165:1799-1807, herein incorporated by reference. Likewise, the High Pure RNA Paraffin Kit (Roche) can be used. Paraffin is removed by xylene extraction followed by ethanol wash. RNA can be isolated from sectioned tissue blocks using the MasterPure Purification kit (Epicenter, Madison, Wis.); a DNase I treatment step is included. RNA can be extracted from frozen samples using Trizol reagent according to the supplier's instructions (Invitrogen Life Technologies, Carlsbad, Calif.). Samples with measurable residual genomic DNA can be resubjected to DNaseI treatment and assayed for DNA contamination. All purification, DNase treatment, and other steps can be performed according to the manufacturer's protocol. After total RNA isolation, samples can be stored at −80° C. until use.

General methods for mRNA extraction are well known in the art and are disclosed in standard textbooks of molecular biology, including Ausubel et al., ed., Current Protocols in Molecular Biology, John Wiley & Sons, New York 1987-1999. Methods for RNA extraction from paraffin embedded tissues are disclosed, for example, in Rupp and Locker (Lab Invest. 56:A67, 1987) and De Andres et al. (Biotechniques 18:42-44, 1995). In particular, RNA isolation can be performed using a purification kit, a buffer set and protease from commercial manufacturers, such as Qiagen (Valencia, Calif.), according to the manufacturer's instructions. For example, total RNA from cells in culture can be isolated using Qiagen RNeasy mini-columns. Other commercially available RNA isolation kits include MasterPure™. Complete DNA and RNA Purification Kit (Epicentre, Madison, Wis.) and Paraffin Block RNA Isolation Kit (Ambion, Austin, Tex.). Total RNA from tissue samples can be isolated, for example, using RNA Stat-60 (Tel-Test, Friendswood, Tex.). RNA prepared from a tumor can be isolated, for example, by cesium chloride density gradient centrifugation. Additionally, large numbers of tissue samples can readily be processed using techniques well known to those of skill in the art, such as, for example, the single-step RNA isolation process of Chomczynski (U.S. Pat. No. 4,843,155, incorporated by reference in its entirety for all purposes).

In one embodiment, a sample comprises cells harvested from a head and neck tissue sample, for example, a squamous cell carcinoma sample. Cells can be harvested from a biological sample using standard techniques known in the art. For example, in one embodiment, cells are harvested by centrifuging a cell sample and resuspending the pelleted cells. The cells can be resuspended in a buffered solution such as phosphate-buffered saline (PBS). After centrifuging the cell suspension to obtain a cell pellet, the cells can be lysed to extract nucleic acid, e.g, messenger RNA. All samples obtained from a subject, including those subjected to any sort of further processing, are considered to be obtained from the subject.

The sample, in one embodiment, is further processed before the detection of the biomarker levels of the combination of biomarkers set forth herein. For example, mRNA in a cell or tissue sample can be separated from other components of the sample. The sample can be concentrated and/or purified to isolate mRNA in its non-natural state, as the mRNA is not in its natural environment. For example, studies have indicated that the higher order structure of mRNA in vivo differs from the in vitro structure of the same sequence (see, e.g., Rouskin et al. (2014). Nature 505, pp. 701-705, incorporated herein in its entirety for all purposes).

mRNA from the sample in one embodiment, is hybridized to a synthetic DNA probe, which in some embodiments, includes a detection moiety (e.g., detectable label, capture sequence, barcode reporting sequence). Accordingly, in these embodiments, a non-natural mRNA-cDNA complex is ultimately made and used for detection of the biomarker. In another embodiment, mRNA from the sample is directly labeled with a detectable label, e.g., a fluorophore. In a further embodiment, the non-natural labeled-mRNA molecule is hybridized to a cDNA probe and the complex is detected.

In one embodiment, once the mRNA is obtained from a sample, it is converted to complementary DNA (cDNA) prior to the hybridization reaction or is used in a hybridization reaction together with one or more cDNA probes. cDNA does not exist in vivo and therefore is a non-natural molecule. Furthermore, cDNA-mRNA hybrids are synthetic and do not exist in vivo. Besides cDNA not existing in vivo, cDNA is necessarily different than mRNA, as it includes deoxyribonucleic acid and not ribonucleic acid. The cDNA is then amplified, for example, by the polymerase chain reaction (PCR) or other amplification method known to those of ordinary skill in the art. For example, other amplification methods that may be employed include the ligase chain reaction (LCR) (Wu and Wallace, Genomics, 4:560 (1989), Landegren et al., Science, 241:1077 (1988), incorporated by reference in its entirety for all purposes, transcription amplification (Kwoh et al., *Proc. Natl. Acad. Sci. USA*, 86:1173 (1989), incorporated by reference in its entirety for all purposes), self-sustained sequence replication (Guatelli et al., *Proc. Nat. Acad. Sci. USA*, 87:1874 (1990), incorporated by reference in its entirety for all purposes), incorporated by reference in its entirety for all purposes, and nucleic acid based sequence amplification (NASBA). Guidelines for selecting primers for PCR amplification are known to those of ordinary skill in the art. See, e.g., McPherson et al., PCR Basics: From Background to Bench, Springer-Verlag, 2000, incorporated by reference in its entirety for all purposes. The product of this amplification reaction, i.e., amplified cDNA is also necessarily a non-natural product. First, as mentioned above, cDNA is a non-natural molecule. Second, in the case of PCR, the amplification process serves to create hundreds of millions of cDNA copies for every individual cDNA molecule of starting material. The numbers of copies generated are far removed from the number of copies of mRNA that are present in vivo.

In one embodiment, cDNA is amplified with primers that introduce an additional DNA sequence (e.g., adapter, reporter, capture sequence or moiety, barcode) onto the fragments (e.g., with the use of adapter-specific primers), or mRNA or cDNA biomarker sequences are hybridized directly to a cDNA probe comprising the additional sequence (e.g., adapter, reporter, capture sequence or moiety, barcode). Amplification and/or hybridization of mRNA to a cDNA probe therefore serves to create non-natural double stranded molecules from the non-natural single stranded cDNA, or the mRNA, by introducing additional sequences and forming non-natural hybrids. Further, as known to those of ordinary skill in the art, amplification procedures have error rates associated with them. Therefore, amplification introduces further modifications into the cDNA molecules. In one embodiment, during amplification with the adapter-specific primers, a detectable label, e.g., a fluorophore, is added to single strand cDNA molecules. Amplification therefore also serves to create DNA complexes that do not occur in nature, at least because (i) cDNA does not exist in vivo, (i) adapter sequences are added to the ends of cDNA molecules to make DNA sequences that do not exist in vivo, (ii) the error rate associated with amplification further creates DNA sequences that do not exist in vivo, (iii) the disparate structure of the cDNA molecules as compared to what exists in nature, and (iv) the chemical addition of a detectable label to the cDNA molecules.

In some embodiments, the expression of a biomarker of interest is detected at the nucleic acid level via detection of non-natural cDNA molecules.

In some embodiments, the method for head and neck cancer SCC subtyping includes detecting expression levels of a classifier biomarker set in a sample obtained from a subject. The method can further comprise detecting expression levels of said classifier biomarker set in one or more control or reference samples. The one or more control or reference samples can be selected from a normal or HNSCC-free sample, a HNSCC AT sample, a HNSCC HPV+ AT-like sample, a HNSCC BA sample, a HNSCC MS sample, a HNSCC CL sample or any combination thereof. In some embodiments, the detecting includes all of the classifier biomarkers of Table 1 or Table 3 at the nucleic acid level or protein level. In some embodiments, the detecting includes all of the classifier biomarkers of Table 1 at the nucleic acid level or protein level. In another embodiment, a single or a subset or a plurality of the classifier biomarkers of Table 1 are detected, for example, from about 18 to about 36. For example, in one embodiment, from about 9 to about 18, from about 18 to about 36, from about 36 to about 72, from about 72 to about 108, from about 108 to about 144 of the biomarkers in Table 1 are detected in a method to determine the Head and Neck cancer SQ subtype. In another embodiment, each of the biomarkers from Table 1 is detected in a method to determine the Head and Neck cancer subtype. In another embodiment, 36 of the biomarkers from Table 1 are selected as the gene signatures for a specific Head and Neck cancer SQ subtype. In some embodiments, the detecting includes all of the classifier biomarkers of Table 3 at the nucleic acid level or protein level. In another embodiment, a single or a subset or a plurality of the classifier biomarkers of Table 3 are detected, for example, from about 10 to about 20. For example, in one embodiment, from about 5 to about 10, from about 10 to about 20, from about 20 to about 40, from about 40 to about 60, from about 60 to about 80 of the biomarkers in Table 3 are detected in a method to determine the Head and Neck cancer SQ subtype. In another embodiment, each of the biomarkers from Table 3 is detected in a method to determine the Head and Neck cancer subtype. In another embodiment, 20 of the biomarkers from Table 3 are selected as the gene signatures for a specific Head and Neck cancer SQ subtype. The detecting can be performed by any suitable technique including, but not limited to, RNA-seq, a reverse transcriptase polymerase chain reaction (RT-PCR), a microarray hybridization assay, or another hybridization assay, e.g., a NanoString assay for example, with primers and/or probes specific to the classifier biomarkers, and/or the like. In some cases, the primers useful for the amplification methods (e.g., RT-PCR or qRT-PCR) are any forward and reverse primers suitable for binding to a classifier gene provided herein, such as the classifier biomarkers listed in Table 1 or Table 3.

The biomarkers described herein include RNA comprising the entire or partial sequence of any of the nucleic acid sequences of interest, or their non-natural cDNA product, obtained synthetically in vitro in a reverse transcription reaction. The term "fragment" is intended to refer to a portion of the polynucleotide that generally comprise at least 10, 15, 20, 50, 75, 100, 150, 200, 250, 300, 350, 400, 450, 500, 550, 600, 650, 700, 800, 900, 1,000, 1,200, or 1,500 contiguous nucleotides, or up to the number of nucleotides present in a full-length biomarker polynucleotide disclosed herein. A fragment of a biomarker polynucleotide will generally encode at least 15, 25, 30, 50, 100, 150, 200, or 250 contiguous amino acids, or up to the total number of amino acids present in a full-length biomarker protein of the invention.

In some embodiments, overexpression, such as of an RNA transcript or its expression product, is determined by normalization to the level of reference RNA transcripts or their expression products, which can be all measured transcripts (or their products) in the sample or a particular reference set of RNA transcripts (or their non-natural cDNA products). Normalization is performed to correct for or normalize away both differences in the amount of RNA or cDNA assayed and variability in the quality of the RNA or cDNA used. Therefore, an assay typically measures and incorporates the expression of certain normalizing genes, including well known housekeeping genes, such as, for example, GAPDH and/or β-Actin. Alternatively, normalization can be based on the mean or median signal of all of the assayed biomarkers or a large subset thereof (global normalization approach).

Isolated mRNA can be used in hybridization or amplification assays that include, but are not limited to, Southern or Northern analyses, PCR analyses and probe arrays, NanoString Assays. One method for the detection of mRNA levels involves contacting the isolated mRNA or synthesized cDNA with a nucleic acid molecule (probe) that can hybridize to the mRNA encoded by the gene being detected. The nucleic acid probe can be, for example, a cDNA, or a portion thereof, such as an oligonucleotide of at least 7, 15, 30, 50, 100, 250, or 500 nucleotides in length and sufficient to specifically hybridize under stringent conditions to the non-natural cDNA or mRNA biomarker of the present invention.

As explained above, in one embodiment, once the mRNA is obtained from a sample, it is converted to complementary DNA (cDNA) in a hybridization reaction. Conversion of the mRNA to cDNA can be performed with oligonucleotides or primers comprising sequence that is complementary to a portion of a specific mRNA. Conversion of the mRNA to cDNA can be performed with oligonucleotides or primers comprising random sequence. Conversion of the mRNA to cDNA can be performed with oligonucleotides or primers comprising sequence that is complementary to the poly(A)

tail of an mRNA. cDNA does not exist in vivo and therefore is a non-natural molecule. In a further embodiment, the cDNA is then amplified, for example, by the polymerase chain reaction (PCR) or other amplification method known to those of ordinary skill in the art. PCR can be performed with the forward and/or reverse primers comprising sequence complementary to at least a portion of a classifier gene provided herein, such as the classifier biomarkers in Table 1 or Table 3. The product of this amplification reaction, i.e., amplified cDNA is necessarily a non-natural product. As mentioned above, cDNA is a non-natural molecule. Second, in the case of PCR, the amplification process serves to create hundreds of millions of cDNA copies for every individual cDNA molecule of starting material. The number of copies generated is far removed from the number of copies of mRNA that are present in vivo.

In one embodiment, cDNA is amplified with primers that introduce an additional DNA sequence (adapter sequence) onto the fragments (with the use of adapter-specific primers). The adaptor sequence can be a tail, wherein the tail sequence is not complementary to the cDNA. For example, the forward and/or reverse primers comprising sequence complementary to at least a portion of a classifier gene provided herein, such as the classifier biomarkers from Table 1 or Table 3 can comprise tail sequence. Amplification therefore serves to create non-natural double stranded molecules from the non-natural single stranded cDNA, by introducing barcode, adapter and/or reporter sequences onto the already non-natural cDNA. In one embodiment, during amplification with the adapter-specific primers, a detectable label, e.g., a fluorophore, is added to single strand cDNA molecules. Amplification therefore also serves to create DNA complexes that do not occur in nature, at least because (i) cDNA does not exist in vivo, (ii) adapter sequences are added to the ends of cDNA molecules to make DNA sequences that do not exist in vivo, (iii) the error rate associated with amplification further creates DNA sequences that do not exist in vivo, (iv) the disparate structure of the cDNA molecules as compared to what exists in nature, and (v) the chemical addition of a detectable label to the cDNA molecules.

In one embodiment, the synthesized cDNA (for example, amplified cDNA) is immobilized on a solid surface via hybridization with a probe, e.g., via a microarray. In another embodiment, cDNA products are detected via real-time polymerase chain reaction (PCR) via the introduction of fluorescent probes that hybridize with the cDNA products. For example, in one embodiment, biomarker detection is assessed by quantitative fluorogenic RT-PCR (e.g., with TaqMan® probes). For PCR analysis, well known methods are available in the art for the determination of primer sequences for use in the analysis.

Biomarkers provided herein in one embodiment, are detected via a hybridization reaction that employs a capture probe and/or a reporter probe. For example, the hybridization probe is a probe derivatized to a solid surface such as a bead, glass or silicon substrate. In another embodiment, the capture probe is present in solution and mixed with the patient's sample, followed by attachment of the hybridization product to a surface, e.g., via a biotin-avidin interaction (e.g., where biotin is a part of the capture probe and avidin is on the surface). The hybridization assay, in one embodiment, employs both a capture probe and a reporter probe. The reporter probe can hybridize to either the capture probe or the biomarker nucleic acid. Reporter probes e.g., are then counted and detected to determine the level of biomarker(s) in the sample. The capture and/or reporter probe, in one embodiment contain a detectable label, and/or a group that allows functionalization to a surface.

For example, the nCounter gene analysis system (see, e.g., Geiss et al. (2008) Nat. Biotechnol. 26, pp. 317-325, incorporated by reference in its entirety for all purposes, is amenable for use with the methods provided herein.

Hybridization assays described in U.S. Pat. Nos. 7,473,767 and 8,492,094, the disclosures of which are incorporated by reference in their entireties for all purposes, are amenable for use with the methods provided herein, i.e., to detect the biomarkers and biomarker combinations described herein.

Biomarker levels may be monitored using a membrane blot (such as used in hybridization analysis such as Northern, Southern, dot, and the like), or microwells, sample tubes, gels, beads, or fibers (or any solid support comprising bound nucleic acids). See, for example, U.S. Pat. Nos. 5,770,722, 5,874,219, 5,744,305, 5,677,195 and 5,445,934, each incorporated by reference in their entireties.

In one embodiment, microarrays are used to detect biomarker levels. Microarrays are particularly well suited for this purpose because of the reproducibility between different experiments. DNA microarrays provide one method for the simultaneous measurement of the expression levels of large numbers of genes. Each array consists of a reproducible pattern of capture probes attached to a solid support. Labeled RNA or DNA is hybridized to complementary probes on the array and then detected by laser scanning hybridization intensities for each probe on the array are determined and converted to a quantitative value representing relative gene expression levels. See, for example, U.S. Pat. Nos. 6,040,138, 5,800,992 and 6,020,135, 6,033,860, and 6,344,316, each incorporated by reference in their entireties. High-density oligonucleotide arrays are particularly useful for determining the gene expression profile for a large number of RNAs in a sample.

Techniques for the synthesis of these arrays using mechanical synthesis methods are described in, for example, U.S. Pat. No. 5,384,261. Although a planar array surface is generally used, the array can be fabricated on a surface of virtually any shape or even a multiplicity of surfaces. Arrays can be nucleic acids (or peptides) on beads, gels, polymeric surfaces, fibers (such as fiber optics), glass, or any other appropriate substrate. See, for example, U.S. Pat. Nos. 5,770,358, 5,789,162, 5,708,153, 6,040,193 and 5,800,992, each incorporated by reference in their entireties. Arrays can be packaged in such a manner as to allow for diagnostics or other manipulation of an all-inclusive device. See, for example, U.S. Pat. Nos. 5,856,174 and 5,922,591, each incorporated by reference in their entireties.

Serial analysis of gene expression (SAGE) in one embodiment is employed in the methods described herein. SAGE is a method that allows the simultaneous and quantitative analysis of a large number of gene transcripts, without the need of providing an individual hybridization probe for each transcript. First, a short sequence tag (about 10-14 bp) is generated that contains sufficient information to uniquely identify a transcript, provided that the tag is obtained from a unique position within each transcript. Then, many transcripts are linked together to form long serial molecules, that can be sequenced, revealing the identity of the multiple tags simultaneously. The expression pattern of any population of transcripts can be quantitatively evaluated by determining the abundance of individual tags, and identifying the gene corresponding to each tag. See, Velculescu et al. Science 270:484-87, 1995; Cell 88:243-51, 1997, incorporated by reference in its entirety.

An additional method of biomarker level analysis at the nucleic acid level is the use of a sequencing method, for example, RNAseq, next generation sequencing, and massively parallel signature sequencing (MPSS), as described by Brenner et al. (Nat. Biotech. 18:630-34, 2000, incorporated by reference in its entirety). This is a sequencing approach that combines non-gel-based signature sequencing with in vitro cloning of millions of templates on separate 5 µm diameter microbeads. First, a microbead library of DNA templates is constructed by in vitro cloning. This is followed by the assembly of a planar array of the template-containing microbeads in a flow cell at a high density (typically greater than $3.0 \times 10^6$ microbeads/cm$^2$). The free ends of the cloned templates on each microbead are analyzed simultaneously, using a fluorescence-based signature sequencing method that does not require DNA fragment separation. This method has been shown to simultaneously and accurately provide, in a single operation, hundreds of thousands of gene signature sequences from a yeast cDNA library.

Another method of biomarker level analysis at the nucleic acid level is the use of an amplification method such as, for example, RT-PCR or quantitative RT-PCR (qRT-PCR). Methods for determining the level of biomarker mRNA in a sample may involve the process of nucleic acid amplification, e.g., by RT-PCR (the experimental embodiment set forth in Mullis, 1987, U.S. Pat. No. 4,683,202), ligase chain reaction (Barany (1991) Proc. Natl. Acad. Sci. USA 88:189-193), self-sustained sequence replication (Guatelli et al. (1990) Proc. Natl. Acad. Sci. USA 87:1874-1878), transcriptional amplification system (Kwoh et al. (1989) Proc. Natl. Acad. Sci. USA 86:1173-1177), Q-Beta Replicase (Lizardi et al. (1988) Bio/Technology 6:1197), rolling circle replication (Lizardi et al., U.S. Pat. No. 5,854,033) or any other nucleic acid amplification method, followed by the detection of the amplified molecules using techniques well known to those of skill in the art. Numerous different PCR or qRT-PCR protocols are known in the art and can be directly applied or adapted for use using the presently described compositions for the detection and/or quantification of expression of discriminative genes in a sample. See, for example, Fan et al. (2004) Genome Res. 14:878-885, herein incorporated by reference. Generally, in PCR, a target polynucleotide sequence is amplified by reaction with at least one oligonucleotide primer or pair of oligonucleotide primers. The primer(s) hybridize to a complementary region of the target nucleic acid and a DNA polymerase extends the primer(s) to amplify the target sequence. Under conditions sufficient to provide polymerase-based nucleic acid amplification products, a nucleic acid fragment of one size dominates the reaction products (the target polynucleotide sequence which is the amplification product). The amplification cycle is repeated to increase the concentration of the single target polynucleotide sequence. The reaction can be performed in any thermocycler commonly used for PCR.

Quantitative RT-PCR (qRT-PCR) (also referred as real-time RT-PCR) is preferred under some circumstances because it provides not only a quantitative measurement, but also reduced time and contamination. As used herein, "quantitative PCR" (or "real time qRT-PCR") refers to the direct monitoring of the progress of a PCR amplification as it is occurring without the need for repeated sampling of the reaction products. In quantitative PCR, the reaction products may be monitored via a signaling mechanism (e.g., fluorescence) as they are generated and are tracked after the signal rises above a background level but before the reaction reaches a plateau. The number of cycles required to achieve a detectable or "threshold" level of fluorescence varies directly with the concentration of amplifiable targets at the beginning of the PCR process, enabling a measure of signal intensity to provide a measure of the amount of target nucleic acid in a sample in real time. A DNA binding dye (e.g., SYBR green) or a labeled probe can be used to detect the extension product generated by PCR amplification. Any probe format utilizing a labeled probe comprising the sequences of the invention may be used.

Immunohistochemistry methods are also suitable for detecting the levels of the biomarkers of the present invention. Samples can be frozen for later preparation or immediately placed in a fixative solution. Tissue samples can be fixed by treatment with a reagent, such as formalin, gluteraldehyde, methanol, or the like and embedded in paraffin. Methods for preparing slides for immunohistochemical analysis from formalin-fixed, paraffin-embedded tissue samples are well known in the art.

In one embodiment, the levels of the biomarkers provided herein, such as the classifier biomarkers of Table 1 (or subsets thereof, for example 18 to 36, 36 to 54, 54 to 72, 72 to 90, 90 to 108, 108 to 126, or 126 to 144 biomarkers), are normalized against the expression levels of all RNA transcripts or their non-natural cDNA expression products, or protein products in the sample, or of a reference set of RNA transcripts or a reference set of their non-natural cDNA expression products, or a reference set of their protein products in the sample. In one embodiment, the levels of the biomarkers provided herein, such as the classifier biomarkers of Table 3 (or subsets thereof, for example 10 to 20, 20 to 30, 30 to 40, 40 to 50, 50 to 60, 60 to 70, or 70 to 80 biomarkers), are normalized against the expression levels of all RNA transcripts or their non-natural cDNA expression products, or protein products in the sample, or of a reference set of RNA transcripts or a reference set of their non-natural cDNA expression products, or a reference set of their protein products in the sample.

In one embodiment, HNSCC subtypes can be evaluated using levels of protein expression of one or more of the classifier genes provided herein, such as the classifier biomarkers listed in Table 1 or Table 3. The level of protein expression can be measured using an immunological detection method. Immunological detection methods which can be used herein include, but are not limited to, competitive and non-competitive assay systems using techniques such as Western blots, radioimmunoassays, ELISA (enzyme linked immunosorbent assay), "sandwich" immunoassays, immunoprecipitation assays, precipitin reactions, gel diffusion precipitin reactions, immunodiffusion assays, agglutination assays, complement-fixation assays, immunoradiometric assays, fluorescent immunoassays, protein A immunoassays, and the like. Such assays are routine and well known in the art (see, e.g., Ausubel et al, eds, 1994, *Current Protocols in Molecular Biology*, Vol. I, John Wiley & Sons, Inc., New York, which is incorporated by reference herein in its entirety).

In one embodiment, antibodies specific for biomarker proteins are utilized to detect the expression of a biomarker protein in a body sample. The method comprises obtaining a body sample from a patient or a subject, contacting the body sample with at least one antibody directed to a biomarker that is selectively expressed in Head and Neck cancer cells, and detecting antibody binding to determine if the biomarker is expressed in the patient sample. In one aspect of the present invention provided is an immunocytochemistry technique for diagnosing Head and Neck cancer subtypes. One of skill in the art will recognize that the immunocytochemistry method described herein below may be performed manually or in an automated fashion.

As provided throughout, the methods set forth herein provide a method for determining the Head and Neck cancer SCC subtype of a patient. Once the biomarker levels are determined, for example by measuring non-natural cDNA biomarker levels or non-natural mRNA-cDNA biomarker complexes, the biomarker levels are compared to reference values or a reference sample as provided herein, for example with the use of statistical methods or direct comparison of detected levels, to make a determination of the Head and Neck cancer molecular SCC subtype. Based on the comparison, the patient's Head and Neck cancer sample is SCC classified, e.g., as BA, MS, AT or CL.

In one embodiment, expression level values of the at least one classifier biomarkers provided herein, such as the classifier biomarkers of Table 1 are compared to reference expression level value(s) from at least one sample training set, wherein the at least one sample training set comprises expression level values from a reference sample(s). In a further embodiment, the at least one sample training set comprises expression level values of the at least one classifier biomarkers provided herein, such as the classifier biomarkers of Table 1 or Table 3 from a HNSCC BA, HNSCC MS, HNSCC AT, HNSCC CL, or HNSCC-free sample or a combination thereof.

In a separate embodiment, hybridization values of the at least one classifier biomarkers provided herein, such as the classifier biomarkers of Table 1 or Table 3 are compared to reference hybridization value(s) from at least one sample training set, wherein the at least one sample training set comprises hybridization values from a reference sample(s). In a further embodiment, the at least one sample training set comprises hybridization values of the at least one classifier biomarkers provided herein, such as the classifier biomarkers of Table 1 or Table 3 from a HNSCC BA, HNSCC MS, HNSCC AT, HNSCC CL, or HNSCC-free sample, or a combination thereof. Methods for comparing detected levels of biomarkers to reference values and/or reference samples are provided herein. Based on this comparison, in one embodiment a correlation between the biomarker levels obtained from the subject's sample and the reference values is obtained. An assessment of the Head and Neck cancer SCC subtype is then made.

Various statistical methods can be used to aid in the comparison of the biomarker levels obtained from the patient and reference biomarker levels, for example, from at least one sample training set.

In one embodiment, a supervised pattern recognition method is employed. Examples of supervised pattern recognition methods can include, but are not limited to, the nearest centroid methods (Dabney (2005) Bioinformatics 21(22):4148-4154 and Tibshirani et al. (2002) Proc. Natl. Acad. Sci. USA 99(10):6576-6572); soft independent modeling of class analysis (SIMCA) (see, for example, Wold, 1976); partial least squares analysis (PLS) (see, for example, Wold, 1966; Joreskog, 1982; Frank, 1984; Bro, R., 1997); linear descriminant analysis (LDA) (see, for example, Nillson, 1965); K-nearest neighbour analysis (KNN) (sec, for example, Brown et al., 1996); artificial neural networks (ANN) (see, for example, Wasserman, 1989; Anker et al., 1992; Hare, 1994); probabilistic neural networks (PNNs) (see, for example, Parzen, 1962; Bishop, 1995; Speckt, 1990; Broomhead et al., 1988; Patterson, 1996); rule induction (RI) (see, for example, Quinlan, 1986); and, Bayesian methods (see, for example, Bretthorst, 1990a, 1990b, 1988). In one embodiment, the classifier for identifying tumor subtypes based on gene expression data is the centroid based method described in Mullins et al. (2007) Clin Chem. 53(7):1273-9, each of which is herein incorporated by reference in its entirety.

In other embodiments, an unsupervised training approach is employed, and therefore, no training set is used.

Referring to sample training sets for supervised learning approaches again, in some embodiments, a sample training set(s) can include expression data of a plurality or all of the classifier biomarkers (e.g., all the classifier biomarkers of Table 1 or Table 3) from a HNSCC sample. The plurality of classifier biomarkers can comprise at least two classifier biomarkers, at least 9 classifier biomarkers, at least 18 classifier biomarkers, at least 36 classifier biomarkers, at least 54 classifier biomarkers, at least 72 classifier biomarkers, at least 90 classifier biomarkers, at least 108 classifier biomarkers, at least 126 classifier biomarkers or at least 144 classifier biomarkers of Table 1. The plurality of classifier biomarkers can comprise at least two classifier biomarkers, at least 10 classifier biomarkers, at least 20 classifier biomarkers, at least 30 classifier biomarkers, at least 40 classifier biomarkers, at least 50 classifier biomarkers, at least 60 classifier biomarkers, at least 70 classifier biomarkers or at least 80 classifier biomarkers of Table 3. In some embodiments, the sample training set(s) are normalized to remove sample-to-sample variation.

In some embodiments, comparing can include applying a statistical algorithm, such as, for example, any suitable multivariate statistical analysis model, which can be parametric or non-parametric. In some embodiments, applying the statistical algorithm can include determining a correlation between the expression data obtained from the human head and neck tissue sample and the expression data from the HNSCC training set(s). In some embodiments, cross-validation is performed, such as (for example), leave-one-out cross-validation (LOOCV). In some embodiments, integrative correlation is performed. In some embodiments, a Spearman correlation is performed. In some embodiments, a centroid based method is employed for the statistical algorithm as described in Mullins et al. (2007) Clin Chem. 53(7):1273-9, and based on gene expression data, which is herein incorporated by reference in its entirety.

Results of the gene expression performed on a sample from a subject (test sample) may be compared to a biological sample(s) or data derived from a biological sample(s) that is known or suspected to be normal ("reference sample" or "normal sample", e.g., non-HNSCC sample). In some embodiments, a reference sample or reference gene expression data is obtained or derived from an individual known to have a particular molecular subtype of SCC, i.e., BA, MS, AT or CL.

The reference sample may be assayed at the same time, or at a different time from the test sample. Alternatively, the biomarker level information from a reference sample may be stored in a database or other means for access at a later date.

The biomarker level results of an assay on the test sample may be compared to the results of the same assay on a reference sample. In some cases, the results of the assay on the reference sample are from a database, or a reference value(s). In some cases, the results of the assay on the reference sample are a known or generally accepted value or range of values by those skilled in the art. In some cases, the comparison is qualitative. In other cases, the comparison is quantitative. In some cases, qualitative or quantitative comparisons may involve but are not limited to one or more of the following: comparing fluorescence values, spot intensities, absorbance values, chemiluminescent signals, histograms, critical threshold values, statistical significance values, expression levels of the genes described herein, mRNA copy numbers.

In one embodiment, an odds ratio (OR) is calculated for each biomarker level panel measurement. Here, the OR is a measure of association between the measured biomarker values for the patient and an outcome, e.g., HNSCC subtype. For example, see, J Can. Acad. Child Adolesc. Psychiatry 2010; 19(3): 227-229, which is incorporated by reference in its entirety for all purposes.

In one embodiment, a specified statistical confidence level may be determined in order to provide a confidence level regarding the Head and Neck cancer subtype. For example, it may be determined that a confidence level of greater than 90% may be a useful predictor of the Head and Neck cancer subtype. In other embodiments, more or less stringent confidence levels may be chosen. For example, a confidence level of about or at least about 50%, 60%, 70%, 75%, 80%, 85%, 90%, 95%, 97.5%, 99%, 99.5%, or 99.9% may be chosen. The confidence level provided may in some cases be related to the quality of the sample, the quality of the data, the quality of the analysis, the specific methods used, and/or the number of gene expression values (i.e., the number of genes) analyzed. The specified confidence level for providing the likelihood of response may be chosen on the basis of the expected number of false positives or false negatives. Methods for choosing parameters for achieving a specified confidence level or for identifying markers with diagnostic power include but are not limited to Receiver Operating Characteristic (ROC) curve analysis, binormal ROC, principal component analysis, odds ratio analysis, partial least squares analysis, singular value decomposition, least absolute shrinkage and selection operator analysis, least angle regression, and the threshold gradient directed regularization method.

Determining the HNSCC subtype in some cases can be improved through the application of algorithms designed to normalize and or improve the reliability of the gene expression data. In some embodiments of the present invention, the data analysis utilizes a computer or other device, machine or apparatus for application of the various algorithms described herein due to the large number of individual data points that are processed. A "machine learning algorithm" refers to a computational-based prediction methodology, also known to persons skilled in the art as a "classifier," employed for characterizing a gene expression profile or profiles, e.g., to determine the HNSCC subtype. The biomarker levels, determined by, e.g., microarray-based hybridization assays, sequencing assays, NanoString assays, etc., are in one embodiment subjected to the algorithm in order to classify the profile. Supervised learning generally involves "training" a classifier to recognize the distinctions among subtypes such as BA positive, MS positive, AT positive or CL positive, and then "testing" the accuracy of the classifier on an independent test set. Therefore, for new, unknown samples the classifier can be used to predict, for example, the class (e.g., BA vs. MS vs. AT vs. CL) in which the samples belong.

In some embodiments, a robust multi-array average (RMA) method may be used to normalize raw data. The RMA method begins by computing background-corrected intensities for each matched cell on a number of microarrays. In one embodiment, the background corrected values are restricted to positive values as described by Irizarry et al. (2003). Biostatistics April 4 (2): 249-64, incorporated by reference in its entirety for all purposes. After background correction, the base-2 logarithm of each background corrected matched-cell intensity is then obtained. The background corrected, log-transformed, matched intensity on each microarray is then normalized using the quantile normalization method in which for each input array and each probe value, the array percentile probe value is replaced with the average of all array percentile points, this method is more completely described by Bolstad et al. Bioinformatics 2003, incorporated by reference in its entirety. Following quantile normalization, the normalized data may then be fit to a linear model to obtain an intensity measure for each probe on each microarray. Tukey's median polish algorithm (Tukey, J. W., Exploratory Data Analysis. 1977, incorporated by reference in its entirety for all purposes) may then be used to determine the log-scale intensity level for the normalized probe set data.

Various other software programs may be implemented. In certain methods, feature selection and model estimation may be performed by logistic regression with lasso penalty using glmnet (Friedman et al. (2010). Journal of statistical software 33(1): 1-22, incorporated by reference in its entirety). Raw reads may be aligned using TopHat (Trapnell et al. (2009). Bioinformatics 25(9): 1105-11, incorporated by reference in its entirety). In methods, top features (N ranging from 10 to 200) are used to train a linear support vector machine (SVM) (Suykens J A K, Vandewalle J. Least Squares Support Vector Machine Classifiers. Neural Processing Letters 1999; 9(3): 293-300, incorporated by reference in its entirety) using the e1071 library (Meyer D. Support vector machines: the interface to libsvm in package e1071. 2014, incorporated by reference in its entirety). Confidence intervals, in one embodiment, are computed using the pROC package (Robin X, Turck N, Hainard A, et al. pROC: an open-source package for R and S+ to analyze and compare ROC curves. BMC bioinformatics 2011; 12: 77, incorporated by reference in its entirety).

In addition, data may be filtered to remove data that may be considered suspect. In one embodiment, data derived from microarray probes that have fewer than about 4, 5, 6, 7 or 8 guanosine+cytosine nucleotides may be considered to be unreliable due to their aberrant hybridization propensity or secondary structure issues. Similarly, data deriving from microarray probes that have more than about 12, 13, 14, 15, 16, 17, 18, 19, 20, 21, or 22 guanosine+cytosine nucleotides may in one embodiment be considered unreliable due to their aberrant hybridization propensity or secondary structure issues.

In some embodiments of the present invention, data from probe-sets may be excluded from analysis if they are not identified at a detectable level (above background).

In some embodiments of the present disclosure, probe-sets that exhibit no, or low variance may be excluded from further analysis. Low-variance probe-sets are excluded from the analysis via a Chi-Square test. In one embodiment, a probe-set is considered to be low-variance if its transformed variance is to the left of the 99 percent confidence interval of the Chi-Squared distribution with (N−1) degrees of freedom. (N−1)*Probe-set Variance/(Gene Probe-set Variance). Chi-Sq(N−1) where N is the number of input CEL files, (N−1) is the degrees of freedom for the Chi-Squared distribution, and the "probe-set variance for the gene" is the average of probe-set variances across the gene. In some embodiments of the present invention, probe-sets for a given mRNA or group of mRNAs may be excluded from further analysis if they contain less than a minimum number of probes that pass through the previously described filter steps for GC content, reliability, variance and the like. For example in some embodiments, probe-sets for a given gene or transcript cluster may be excluded from further analysis if they contain less than about 1, 2, 3, 4, 5, 6, 7, 8, 9, 10, 11, 12, 13, 14, 15, or less than about 20 probes.

Methods of biomarker level data analysis in one embodiment, further include the use of a feature selection algorithm as provided herein. In some embodiments of the present invention, feature selection is provided by use of the LIMMA software package (Smyth, G. K. (2005). Limma: linear models for microarray data. In: Bioinformatics and Computational Biology Solutions using R and Bioconductor, R. Gentleman, V. Carey, S. Dudoit, R. Irizarry, W. Huber (eds.), Springer, New York, pages 397-420, incorporated by reference in its entirety for all purposes).

Methods of biomarker level data analysis, in one embodiment, include the use of a pre-classifier algorithm. For example, an algorithm may use a specific molecular fingerprint to pre-classify the samples according to their composition and then apply a correction/normalization factor. This data/information may then be fed in to a final classification algorithm which would incorporate that information to aid in the final diagnosis.

Methods of biomarker level data analysis, in one embodiment, further include the use of a classifier algorithm as provided herein. In one embodiment of the present invention, a diagonal linear discriminant analysis, k-nearest neighbor algorithm, support vector machine (SVM) algorithm, linear support vector machine, random forest algorithm, or a probabilistic model-based method or a combination thereof is provided for classification of microarray data. In some embodiments, identified markers that distinguish samples (e.g., of varying biomarker level profiles, and/or varying molecular subtypes of HNSCC (e.g., basal, mesemchymal, atypical, classical)) are selected based on statistical significance of the difference in biomarker levels between classes of interest. In some cases, the statistical significance is adjusted by applying a Benjamin Hochberg or another correction for false discovery rate (FDR).

In some cases, the classifier algorithm may be supplemented with a meta-analysis approach such as that described by Fishel and Kaufman et al. 2007 Bioinformatics 23(13): 1599-606, incorporated by reference in its entirety for all purposes. In some cases, the classifier algorithm may be supplemented with a meta-analysis approach such as a repeatability analysis.

Methods for deriving and applying posterior probabilities to the analysis of biomarker level data are known in the art and have been described for example in Smyth, G. K. 2004 *Stat. Appi. Genet. Mol. Biol.* 3: Article 3, incorporated by reference in its entirety for all purposes. In some cases, the posterior probabilities may be used in the methods of the present invention to rank the markers provided by the classifier algorithm.

A statistical evaluation of the results of the biomarker level profiling may provide a quantitative value or values indicative of one or more of the following: molecular subtype of HNSCC (e.g., basal, mesenchymal, atypical, classical); the likelihood of the success of a particular therapeutic intervention, e.g., angiogenesis inhibitor therapy, chemotherapy, or immunotherapy. In one embodiment, the data is presented directly to the physician in its most useful form to guide patient care, or is used to define patient populations in clinical trials or a patient population for a given medication. The results of the molecular profiling can be statistically evaluated using a number of methods known to the art including, but not limited to: the students T test, the two sided T test, Pearson rank sum analysis, hidden Markov model analysis, analysis of q-q plots, principal component analysis, one way ANOVA, two way ANOVA, LIMMA and the like.

In some cases, accuracy may be determined by tracking the subject over time to determine the accuracy of the original diagnosis. In other cases, accuracy may be established in a deterministic manner or using statistical methods. For example, receiver operator characteristic (ROC) analysis may be used to determine the optimal assay parameters to achieve a specific level of accuracy, specificity, positive predictive value, negative predictive value, and/or false discovery rate.

In some cases, the results of the biomarker level profiling assays, are entered into a database for access by representatives or agents of a molecular profiling business, the individual, a medical provider, or insurance provider. In some cases, assay results include sample classification, identification, or diagnosis by a representative, agent or consultant of the business, such as a medical professional. In other cases, a computer or algorithmic analysis of the data is provided automatically. In some cases the molecular profiling business may bill the individual, insurance provider, medical provider, researcher, or government entity for one or more of the following: molecular profiling assays performed, consulting services, data analysis, reporting of results, or database access.

In some embodiments of the present invention, the results of the biomarker level profiling assays are presented as a report on a computer screen or as a paper record. In some embodiments, the report may include, but is not limited to, such information as one or more of the following: the levels of biomarkers (e.g., as reported by copy number or fluorescence intensity, etc.) as compared to the reference sample or reference value(s); the likelihood the subject will respond to a particular therapy, based on the biomarker level values and the HNSCC subtype and proposed therapies.

In one embodiment, the results of the gene expression profiling may be classified into one or more of the following: basal positive, mesenchymal positive, atypical positive or classical positive, basal negative, mesenchymal negative, atypical negative or classical negative; likely to respond to surgery (e.g., neck dissection), radiotherapy, angiogenesis inhibitor, immunotherapy or chemotherapy; unlikely to respond to surgery (e.g., neck dissection), radiotherapy, angiogenesis inhibitor, immunotherapy or chemotherapy; or a combination thereof. In a further embodiment, the results of the gene expression profiling may be further classified into being HPV positive or HPV negative.

In some embodiments of the present invention, results are classified using a trained algorithm. Trained algorithms of the present invention include algorithms that have been developed using a reference set of known gene expression values and/or normal samples, for example, samples from individuals diagnosed with a particular molecular subtype of HNSCC. In some cases, a reference set of known gene expression values are obtained from individuals who have been diagnosed with a particular molecular subtype of HNSCC, and are also known to respond (or not respond) to angiogenesis inhibitor therapy. In some cases, a reference set of known gene expression values are obtained from individuals who have been diagnosed with a particular molecular subtype of HNSCC, and are also known to respond (or not respond) to immunotherapy. In some cases, a reference set of known gene expression values are obtained from individuals who have been diagnosed with a particular molecular subtype of HNSCC, and are also known to respond (or not respond) to chemotherapy. In some cases, the reference sets described above are HPV positive. In some cases, the reference sets described above are HPV negative.

Algorithms suitable for categorization of samples include but are not limited to k-nearest neighbor algorithms, support vector machines, linear discriminant analysis, diagonal linear discriminant analysis, updown, naive Bayesian algorithms, neural network algorithms, hidden Markov model algorithms, genetic algorithms, or any combination thereof.

When a binary classifier is compared with actual true values (e.g., values from a biological sample), there are typically four possible outcomes. If the outcome from a prediction is p (where "p" is a positive classifier output, such as the presence of a deletion or duplication syndrome) and the actual value is also p, then it is called a true positive (TP); however if the actual value is n then it is said to be a false positive (FP). Conversely, a true negative has occurred when both the prediction outcome and the actual value are n (where "n" is a negative classifier output, such as no deletion or duplication syndrome), and false negative is when the prediction outcome is n while the actual value is p. In one embodiment, consider a test that seeks to determine whether a person is likely or unlikely to respond to angiogenesis inhibitor therapy. A false positive in this case occurs when the person tests positive, but actually does respond. A false negative, on the other hand, occurs when the person tests negative, suggesting they are unlikely to respond, when they actually are likely to respond. The same holds true for classifying a Head and Neck cancer subtype.

The positive predictive value (PPV), or precision rate, or post-test probability of disease, is the proportion of subjects with positive test results who are correctly diagnosed as likely or unlikely to respond, or diagnosed with the correct Head and Neck cancer subtype, or a combination thereof. It reflects the probability that a positive test reflects the underlying condition being tested for. Its value does however depend on the prevalence of the disease, which may vary. In one example the following characteristics are provided: FP (false positive); TN (true negative); TP (true positive); FN (false negative). False positive rate (□)=FP/(FP+TN)−specificity; False negative rate (□)=FN/(TP+FN)−sensitivity; Power=sensitivity=1−□□; Likelihood-ratio positive=sensitivity/(1−specificity); Likelihood-ratio negative=(1−sensitivity)/specificity. The negative predictive value (NPV) is the proportion of subjects with negative test results who are correctly diagnosed.

In some embodiments, the results of the biomarker level analysis of the subject methods provide a statistical confidence level that a given diagnosis is correct. In some embodiments, such statistical confidence level is at least about, or more than about 85%, 90%, 91%, 92%, 93%, 94%, 95%, 96%, 97%, 98%, 99% 99.5%, or more.

In some embodiments, the method further includes classifying the Head and Neck tissue sample as a particular Head and Neck cancer subtype based on the comparison of biomarker levels in the sample and reference biomarker levels, for example present in at least one training set. In some embodiments, the Head and Neck tissue sample is classified as a particular subtype if the results of the comparison meet one or more criterion such as, for example, a minimum percent agreement, a value of a statistic calculated based on the percentage agreement such as (for example) a kappa statistic, a minimum correlation (e.g., Pearson's correlation) and/or the like.

It is intended that the methods described herein can be performed by software (stored in memory and/or executed on hardware), hardware, or a combination thereof. Hardware modules may include, for example, a general-purpose processor, a field programmable gate array (FPGA), and/or an application specific integrated circuit (ASIC). Software modules (executed on hardware) can be expressed in a variety of software languages (e.g., computer code), including Unix utilities, C, C++, Java™, Ruby, SQL, SAS®, the R programming language/software environment, Visual Basic™, and other object-oriented, procedural, or other programming language and development tools. Examples of computer code include, but are not limited to, micro-code or micro-instructions, machine instructions, such as produced by a compiler, code used to produce a web service, and files containing higher-level instructions that are executed by a computer using an interpreter. Additional examples of computer code include, but are not limited to, control signals, encrypted code, and compressed code.

Some embodiments described herein relate to devices with a non-transitory computer-readable medium (also can be referred to as a non-transitory processor-readable medium or memory) having instructions or computer code thereon for performing various computer-implemented operations and/or methods disclosed herein. The computer-readable medium (or processor-readable medium) is non-transitory in the sense that it does not include transitory propagating signals per se (e.g., a propagating electromagnetic wave carrying information on a transmission medium such as space or a cable). The media and computer code (also can be referred to as code) may be those designed and constructed for the specific purpose or purposes. Examples of non-transitory computer-readable media include, but are not limited to: magnetic storage media such as hard disks, floppy disks, and magnetic tape; optical storage media such as Compact Disc/Digital Video Discs (CD/DVDs), Compact Disc-Read Only Memories (CD-ROMs), and holographic devices; magneto-optical storage media such as optical disks; carrier wave signal processing modules; and hardware devices that are specially configured to store and execute program code, such as Application-Specific Integrated Circuits (ASICs), Programmable Logic Devices (PLDs), Read-Only Memory (ROM) and Random-Access Memory (RAM) devices. Other embodiments described herein relate to a computer program product, which can include, for example, the instructions and/or computer code discussed herein.

In some embodiments, a single biomarker, or from about 18 to about 36, from about 36 to about 54, from about 54 to about 72, from about 72 to about 90, from about 90 to about 108, from about 108 to about 126, from about 126 to about 144, from about 36 to about 72, from about 36 to about 108, from about 36 to about 144 biomarkers (e.g., as disclosed in Table 1) is capable of classifying subtypes of HNSCC with a predictive success of at least about 70%, at least about 71%, at least about 72%, at least about 73%, at least 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, up to 100%, and all values in between. In some embodiments, any combination of biomarkers disclosed herein (e.g., in Table 1) can be used to obtain a predictive success of at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, up to 100%, and all values in between.

In some embodiments, a single biomarker, or from about 10 to about 20, from about 20 to about 30, from about 20 to about 40, from about 40 to about 50, from about 40 to about 60, from about 60 to about 70, from about 60 to about 80, from about 20 to about 60, from about 20 to about 80, from about 40 to about 80 biomarkers (e.g., as disclosed in Table 3) is capable of classifying subtypes of HNSCC with a predictive success of at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, up to 100%, and all values in between. In some embodiments, any combination of biomarkers disclosed herein (e.g., in Table 3) can be used to obtain a predictive success of at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, up to 100%, and all values in between.

In some embodiments, a single biomarker, or from about 18 to about 36, from about 36 to about 54, from about 54 to about 72, from about 72 to about 90, from about 90 to about 108, from about 108 to about 126, from about 126 to about 144, from about 36 to about 72, from about 36 to about 108, from about 36 to about 144 biomarkers (e.g., as disclosed in Table 1) is capable of classifying subtypes of HNSCC with a sensitivity or specificity of at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, up to 100%, and all values in between. In some embodiments, any combination of biomarkers disclosed herein can be used to obtain a sensitivity or specificity of at least about 70%, at least about 71%, at least about 72%, about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, up to 100%, and all values in between.

In some embodiments, a single biomarker, or from about 10 to about 20, from about 20 to about 30, from about 20 to about 40, from about 40 to about 50, from about 40 to about 60, from about 60 to about 70, from about 60 to about 80, from about 20 to about 60, from about 20 to about 80, from about 40 to about 80 biomarkers (e.g., as disclosed in Table 3) is capable of classifying subtypes of HNSCC with a sensitivity or specificity of at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, up to 100%, and all values in between. In some embodiments, any combination of biomarkers disclosed herein can be used to obtain a sensitivity or specificity of at least about 70%, at least about 71%, at least about 72%, about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, up to 100%, and all values in between.

Classifier Gene Selection

In one embodiment, the methods and compositions provided herein are useful for determining the HNSCC subtype of a sample (e.g., Head and Neck tissue sample) from a patient by analyzing the expression of a set of biomarkers, whereby the set of biomarkers comprise a fewer number of biomarkers that methods known in the art for molecularly classifying HNSCC subtype. In some cases, the set of biomarkers is less than 250, 240, 230, 220, 210, 200, 150, 100, 95 or 90 biomarkers. In some cases, the set of biomarkers is less than 150 biomarkers. In some cases, the set of biomarkers is the set of 144 biomarkers listed in Table 1. In some cases, the set of biomarkers is a sub-set of biomarkers listed Table 1 such as, for example, the 80 biomarkers of Table 3. The biomarkers or classifier genes useful in the methods and compositions provided herein can be selected from one or more HNSCC datasets from one or more databases. The databases can be public databases. In one embodiment, classifier genes (e.g., one or more genes listed in Table 1 and Table 3) useful in the methods and compositions provided herein for detecting or diagnosing HNSCC subtypes were selected from a HNSCC RNAseq dataset from The Cancer Genome Atlas (TCGA). In one embodiment, classifier genes useful for the methods and compositions provided herein such as those in Table 1 are selected by subjecting a large set of classifier genes to an in silico based process in order to determine the minimum number of genes whose expression profile can be used to determine an HNSCC subtype of sample obtained from a subject. In some cases, the large set of classifier genes can be a HNSCC RNAseq dataset such as, for example, from TCGA. In some cases, the large set of classifier genes can be 840-gene classifier described herein, whereby the 840-gene classifier can serve to define gold standard subtype. The in silico process for selecting a gene cassette as provided herein for determining HNSCC subtype of a sample from a patient can comprise, applying or using a Classifying arrays to Nearest Centroid (CLaNC) algorithm with modification on the standard 840 classifier genes to choose an equal number of negatively and positively correlated genes for each subtype. For determination of the optimal number of genes (e.g, 36 per subtype as shown in Table 1 or 20 per subtype as shown in Table 3) to include in the signature, the process can further comprise performing a 5-fold cross validation using TCGA HNSCC dataset as provided herein to produce cross-validation curves as shown in FIG. 1. To get the final list of gene classifiers, the method can further comprise applying the Classifying arrays to Nearest Centroid (CLaNC) to the entire TCGA data set minus 20% of samples with the lowest gold standard subtype prediction strength, and removing an equal number from each subtype.

In one embodiment, the method further comprises validating the gene classifiers. Validation can comprise testing the expression of the classifiers in several fresh frozen publicly available array and RNAseq datasets and calling the subtype based on said expression levels and subsequently comparing the expression with the gold standard subtype calls as defined by the previously published 840-gene signature. Final validation of the gene signature (e.g., Table 1 or Table 3) can then be performed in a newly collected RNAseq dataset of archived formalin-fixed paraffin-embedded (FFPE) HNSCC samples to assure comparable performance in the FFPE samples. In one embodiment, the classifier biomarkers of Table 1 or Table 3 were selected based on the in silico CLaNC process described herein. The gene symbols and official gene names are listed in column 2 and column 3, respectively of Tables 1 and 3.

In one embodiment, the methods of the invention require the detection of at least 1, at least 2, at least 3, at least 4, at least 5, at least 6, at least 7, at least 8, at least 9, at least 10, at least 11, at least 12, at least 13, at least 14, at least 15, at least 16, at least 18, at least 20, at least 22, at least 24, at least 26, at least 28, at least 30, at least 32, at least 34 or up to 36 classifier biomarkers in a Head and Neck cancer cell sample obtained from a patient which expression is altered in order to identify a BA, MS, AT or CL HNSCC subtype. The same applies for other classifier gene expression datasets as provided herein.

In another embodiment, the methods of the invention require the detection of a total of at least 1, at least 2, at least 5, at least 8, at least 10, at least 18, at least 36, at least 54, at least 72, at least 108, at least 126, or up to 144 classifier biomarkers out of the 144 gene biomarkers of Table 1 in a Head and Neck cancer cell sample (e.g., HNSCC sample) obtained from a patient in order to identify a BA, MS, AT or CL HNSCC subtype. In another embodiment, the methods of the invention require the detection of a total of at least 1, at least 2, at least 5, at least 10, at least 20, at least 40, at least 60 or up to 80 classifier biomarkers out of the 80 gene biomarkers of Table 3 in a Head and Neck cancer cell sample (e.g., HNSCC sample) obtained from a patient in order to identify a basal, classical, atypical or mesenchymal Head and Neck squamous cell carcinoma subtype. The same applies for other classifier gene expression datasets as provided herein.

In one embodiment, at least 1, at least 2, at least 3, at least 4, at least 5, at least 6, at least 7, at least 8, at least 10, at least 18, at least 36, at least 54, at least 72, at least 108, at least 126, or up to 144 classifier biomarkers out of the 144 gene biomarkers of Table 1 are "up-regulated" in a specific subtype of HNSCC. In another embodiment, at least 1, at least 2, at least 3, at least 4, at least 5, at least 6, at least 7, at least 8, at least 10, at least 18, at least 36, at least 54, at least 72, at least 108, at least 126, or up to 144 classifier biomarkers out of the 144 gene biomarkers of Table 1 are "down-regulated" in a specific subtype of HNSCC. In one embodiment, at least 1, at least 2, at least 3, at least 4, at least 5, at least 6, at least 7, at least 8, at least 9 or up to 10 biomarkers of Table 3 are "up-regulated" in a specific subtype of head and neck squamous cell carcinoma. In another embodiment, at least 1, at least 2, at least 3, at least 4, at least 5, at least 6, at least 7, at least 8, at least 9 or up to 10 biomarkers of Table 3 are "down-regulated" in a specific subtype of head and neck squamous cell carcinoma. The same applies for other classifier gene expression datasets as provided herein.

In one embodiment, the expression level of an "up-regulated" biomarker as provided herein is increased by about 0.5-fold, about 1-fold, about 1.5-fold, about 2-fold, about 2.5-fold, about 3-fold, about 3.5-fold, about 4-fold, about 4.5-fold, about 5-fold, and any values in between. In another embodiment, the expression level of a "down-regulated" biomarker as provided herein is decreased by about 0.8-fold, about 1.4-fold, about 2-fold, about 2.6-fold, about 3.2-fold, about 3.6-fold, about 4-fold, and any values in between.

It is recognized that additional genes or proteins can be used in the practice of the invention. In general, genes useful in classifying the subtypes of HNSCC, include those that are independently capable of distinguishing between normal versus tumor, or between different classes or grades of HNSCC. A gene is considered to be capable of reliably distinguishing between subtypes if the area under the receiver operator characteristic (ROC) curve is approximately 1.

HPV Status

In one embodiment, the Human Papillomavirus (HPV) status of a subject is determined. The HPV status of the subject can be determined using any of the HPV-specific tests known in the art, alone or in combination, as described in Lewis Jr et al., (2018) Human Papillomavirus Testing in Head and Neck Carcinomas: Guideline From the College of American Pathologists. Archives of Pathology & Laboratory Medicine: May 2018, Vol. 142, No. 5, pp. 559-597, or Venuti A, Paolini F. HPV Detection Methods in Head and Neck Cancer. Head and Neck Pathology. 2012; 6(Suppl 1):63-74, each of which is herein incorporated by reference. Use of any of the known HPV-specific tests can also be used in combination with examining the surrogate marker p16 by immunohistochemistry (IHC) and/or examining hematoxylin-eosin morphology of tissue samples from the subject. The surrogate marker p16 can be markedly overexpressed in tumor cells with transcriptionally active HPV because the viral E7 oncoprotein destabilizes pRb, functionally removing suppression of p16 expression and allowing tumor cells with high p16 levels to bypass pRb-dependent cell cycle arrest as described in Moody C A. Laimins L A. Human papillomavirus oncoproteins: pathways to transformation. Nat Rev Cancer. 2010; 10(8):550-560 and Munger K. Baldwin A. Edwards K M. et al. Mechanisms of human papillomavirus-induced oncogenesis. J Virol. 2004; 78(21): 11451-11460. The result can be marked overexpression of p16, which can make it an excellent surrogate marker of viral infection in the correct context. Results obtained from use of the HPV-specific tests and/or examination of p16 IHC and/or hematoxylin-eosin morphology can indicate that the subject is experiencing ongoing HPV replication. As a result, said subject can be said to be HPV positive.

In one embodiment, the HPV status of a subject is assessed by determining the presence, absence or level of expression of one or more genes or gene products derived therefrom (e.g., messenger RNA (mRNA)) of HPV in a sample obtained from the subject. Determining the presence, absence or level of one or more genes or gene products derived therefrom (e.g., messenger RNA (mRNA)) of an HPV can indicate that said subject is experiencing ongoing HPV replication. Measuring or detecting the presence, absence or expression levels of one or more HPV genes can be done using sequencing (e.g., RNASeq), amplification (e.g., qRT-PCR) or hybridization assays (e.g., microarray analysis or in situ hybridization (ISH) assays). The sequencing assay can be any sequencing assay known in the art such as, for example, Cervista HPV 16/18 assay. The amplification assay can be any amplification assay known in the art such as, for example, the Hologic Aptima HPV assay or Roche Cobas HPV test. The hybridization assay can be any hybridization assay known in the art such as, for example, the Qiagen/Digene HC2 high-risk HPV test or Hologic Cervista HPV HR assay. In one embodiment, HPV status is determined using sequencing such as next-generation sequencing (NGS). For example, HPV status can be determined using NGS RNA sequencing (RNASeq) in order to detect read counts of one or more HPV genes (e.g., HPV E6 and/or E7). In one embodiment, read counts of greater than or equal to 200, 300, 400, 500, 600, 700, 800, 900, 1000, 1250, 1500, 1750 or 2000 are indicative of ongoing HPV replication. In one embodiment, the one or more genes or gene products derived therefrom (e.g., messenger RNA (mRNA)) can be the HPV E6 and/or E7 gene. The one or more genes can be the entire HPV genome or subsets thereof. In one embodiment, HPV status is determined by measuring or detecting expression of the HPV E6 gene and/or E7 gene in combination with one or more additional HPV genes. The HPV can be any type of HPV. In one embodiment, the HPV is selected from HPV types 16, 18, 31, 33, 35, 39, 45, 51, 52, 56, 58, 59, and 68 or any combination thereof. The detection of HPV E6 and E7 mRNA (or any other gene from an HPV genome) can be performed by ISH as described in Ukpo O C et al, High-risk human papillomavirus E6/E7 mRNA detection by a novel in situ hybridization assay strongly correlates with p16 expression and patient outcomes in oropharyngeal squamous cell carcinoma. Am J Surg Pathol. 2011; 35(9):1343-1350, Bishop J A. Ma X-J. Wang H. et al. Detection of transcriptionally active high-risk HPV in patients with head and neck squamous cell carcinoma as visualized by a novel E6/E7 mRNA in situ hybridization method. Am J Surg Pathol. 2012; 36(12):1874-1882, and Kerr D A. Arora K S. Mahadevan K K. et al. Performance of a branch chain RNA in situ hybridization assay for the detection of high-risk human papillomavirus in head and neck squamous cell carcinoma. Am J Surg Pathol. 2016; 39(12):1643-1652, each of which is herein incorporated by reference. In some cases, genes from HPV genomes can be detected using an ISH method as described in Ang K K. Harris J. Wheeler R. et al. Human papillomavirus and survival of patients with oropharyngeal cancer. N Engl J Med. 2010; 363(1):24-35, which is herein incorporated by reference. In some cases, genes from HPV genomes can be detected using the multiplex PCR and ISH methods as described in Fakhry C. Westra W H. Li S. et al. Improved survival of patients with human papillomavirus-positive head and neck squamous cell carcinoma in a prospective clinical trial. J Natl Cancer Inst. 2008; 100(4): 261-269, which is herein incorporated by reference. In some cases, genes from HPV genomes can be detected using the Qiagen HC2 capture assay as described in Elke A. Jarboe, Mark Willis, Brandon Bentz, Luke Buchmann, Jason Hunt, Gary Ellis, Lester Layfield; Detection of Human Papillomavirus Using Hybrid Capture 2 in Oral Brushings From Patients With Oropharyngeal Squamous Cell Carcinoma, American Journal of Clinical Pathology, Volume 135, Issue 5, 1 May 2011, Pages 766-769, which is incorporated by herein by reference. In some cases, the presence of HPV genomes can be detected using RNA-seq and/or whole-exome sequencing methods as described in Parfenov M, Pedamallu C S, Gehlenborg N, et al. Characterization of HPV and host genome interactions in primary head and neck cancers. Proceedings of the National Academy of Sciences of the United States of America. 2014; 111(43):15544-15549, which is herein incorporated by reference. In some cases, the detection of HPV genes (e.g., HPV E6 and E7 mRNA) can be performed using qRT-PCR and/or RNA-seq as described in Kalu N N, Mazumdar T, Peng S, et al. Genomic characterization of human papillomavirus-positive and -negative human squamous cell cancer cell lines. Oncotarget. 2017; 8(49):86369-86383, which is herein incorporated by reference. In some cases, the genes from the HPV genome can be detected in a sample (e.g., head and neck sample) from a subject using the Roche Cobas HPV test as described in Angelique W. Levi, Jane I. Bernstein, Pei Hui, Kara Duch, Kevin Schofield, and David C. Chhieng (2016) A Comparison of the Roche Cobas HPV Test With the Hybrid Capture 2 Test for the Detection of High-Risk Human Papillomavirus Genotypes. Archives of Pathology & Laboratory Medicine: February 2016, Vol. 140, No. 2, pp. 153-157, which is herein incorporated by reference. In some cases, the genes from the HPV genome can be detected in a sample (e.g., head and neck sample) from a subject using the Hologic Aptima HPV assay as described in Max C, Michael G, Dan J, Lilian D M, Bernard J, et al. (2017) Performance of Aptima E6/E7 mRNA HPV assays on fine needle aspirates from cervical lymph nodes of patients with metastatic oropharyngeal squamous cell carcinoma. Otorhinolaryngol Head Neck Surg 2: DOI: 10.15761/OHNS.1000153, or the Hologic Cervista HPV assay as described in Guo, M., Khanna, A., Dhillon, J., Patel, S. J., Feng, J., Williams, M. D., Bell, D. M., Gong, Y., Katz, R. L., Sturgis, E. M. and Staerkel, G. A. (2014), Cervista HPV assays for fine-needle aspiration specimens are a valid option for human papillomavirus testing in patients with oropharyngeal carcinoma. Cancer Cytopathology, 122: 96-103, which is herein incorporated by reference.

In one embodiment, determining a subject's HPV status (e.g., by determining or detecting the presence, absence or level of one or more genes of HPV) is performed in addition to determining an HNSCC subtype of the subject. Further to this embodiment, the subtype is determined by detecting the expression levels of one or more classifier biomarkers using sequencing (e.g., RNASeq), amplification (e.g., qRT-PCR) or hybridization assays (e.g., microarray analysis) as described herein. The one or more biomarkers can be selected from a publically available database (e.g., TCGA HNSCC RNASeq gene expression datasets or any other publically available HNSCC gene expression datasets provided herein). In some embodiments, the biomarkers of Table 1 or Table 3 can be used to specifically determine the subtype of a HNSCC sample obtained from a patient as described herein. Further to these embodiments, determination of the HNSCC subtype can be performed prior to, concurrently with, or following determination of the HPV status of the subject. The HPV status can be determined using the methods provided herein. The HPV can be any type of HPV known in the art (e.g., the 202 types of HPV recognized by the International Human Papillomavirus Reference Center). In one embodiment, the HPV type is 16 18, 33, 35 or any combination thereof. As provided herein, the HPV status can be determined by measuring the gene expression (e.g., gene expression signatures) of HPV markers. In some cases, HPV status can be determined by determining the levels of surrogate HPV markers such as p16 and/or by examining the hematoxylin eosin morphology of tissue samples. In some cases, determining the levels of p16 and/or hematoxylin-eosin morphology can be performed in combination with measuring the gene expression of HPV markers as provided herein. The levels of p16 can be determined using any method known in the art and/or provided herein. The HPV markers can consist of, consist essentially of or comprise the whole HPV genome, or subsets thereof. In one embodiment, the HPV markers consist of, consist essentially of or comprise the HPV E6 and/or E7 gene. In another embodiment, the HPV markers consist of, consist essentially of or comprise the HPV E6 and/or E7 gene in combination with one or more HPV genes. The HPV markers can be measured in the same and/or different sample used to subtype the HNSCC sample as described herein. In one embodiment, the HPV status is determined by detecting read counts of one or more HPV genes (e.g., HPV E6 and/or E7 gene) from an RNAseq analysis of RNA isolated from a sample obtained from a subject such that reads counts above a predetermined threshold are indicative of ongoing, active HPV replication. The predetermined threshold can be 1000 read counts.

In another embodiment, determining a subject's HPV status (e.g., by determining or detecting the presence, absence or level of one or more genes of HPV) is used to determine an HNSCC subtype of the subject. Further to this embodiment, the subtype is determined by detecting the expression levels of one or more classifier biomarkers using sequencing (e.g., RNASeq), amplification (e.g., qRT-PCR) or hybridization assays (e.g., microarray analysis) as described herein in combination with determining the HPV status. The one or more biomarkers can be selected from a publically available database (e.g., TCGA HNSCC RNASeq gene expression datasets or any other publically available HNSCC gene expression datasets provided herein). In some embodiments, the biomarkers of Table 1 or Table 3 can be used in combination with determining the subject's HPV status in order to determine the subtype of a HNSCC sample obtained from the subject as described herein. The HPV status can be determined using the methods provided herein. The HPV can be any type of HPV known in the art (e.g., the 202 types of HPV recognized by the International Human Papillomavirus Reference Center). In one embodiment, the HPV type is 16, 18, 33, 35 or any combination thereof. As provided herein, the HPV status can be determined by measuring the gene expression (e.g., gene expression signatures) of HPV markers. In some cases, HPV status can be determined by determining the levels of surrogate HPV markers such as p16 and/or by examining the hematoxylin eosin morphology of tissue samples. In some cases, determining the levels of p16 and/or hematoxylin-eosin morphology can be performed in combination with measuring the gene expression of HPV markers as provided herein. The levels of p16 can be determined using any method known in the art and/or provided herein. The HPV markers can consist of, consist essentially of or comprise the whole HPV genome, or subsets thereof. In one embodiment, the HPV markers consist of, consist essentially of or comprise the HPV E6 and/or E7 gene. In another embodiment, the HPV markers consist of, consist essentially of or comprise the HPV E6 and/or E7 gene in combination with one or more HPV genes. The HPV markers can be measured in the same and/or different sample used to measure other classifier biomarkers (e.g., biomarkers from Tables 1 or 3) as described herein. In one embodiment, the HPV status is determined by detecting read counts of one or more HPV genes (e.g., HPV E6 and/or E7 gene) from an RNAseq analysis of RNA isolated from a sample obtained from a subject such that read counts above a predetermined threshold are indicative of ongoing, active HPV replication. The predetermined threshold can be 1000 read counts.

Clinical/Therapeutic Uses

Figure 2B:
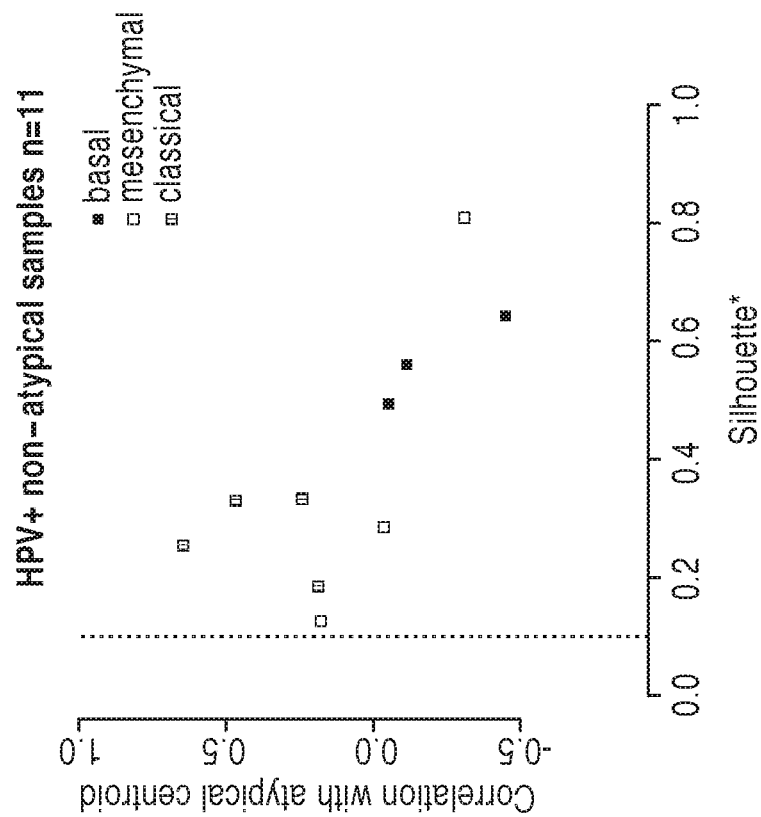
FIG. 2B illustrates the distribution of sample correlation with atypical centroid and silhouette among non-atypical HPV+ samples. Coxph agreed with logrank test (p=0.039). When adjusted for stage p=0.15.
Figure 2A:
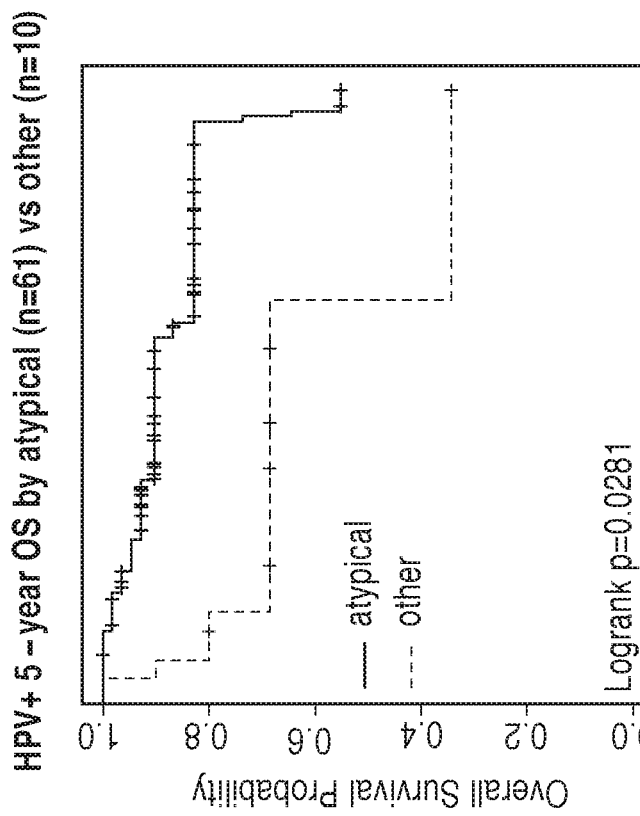
FIG. 2A illustrates survival curves comparing HPV positive atypical vs. HPV positive non-Atypical tumors from TCGA dataset that were subtyped using the 144 gene set (Table 1) showing that HPV positive samples that do not belong to the atypical gene expression subtype or "atypical-like" subtype demonstrate a worse survival and may be more similar to smoking induced non-HPV HNSCC tumors.
Figure 17:
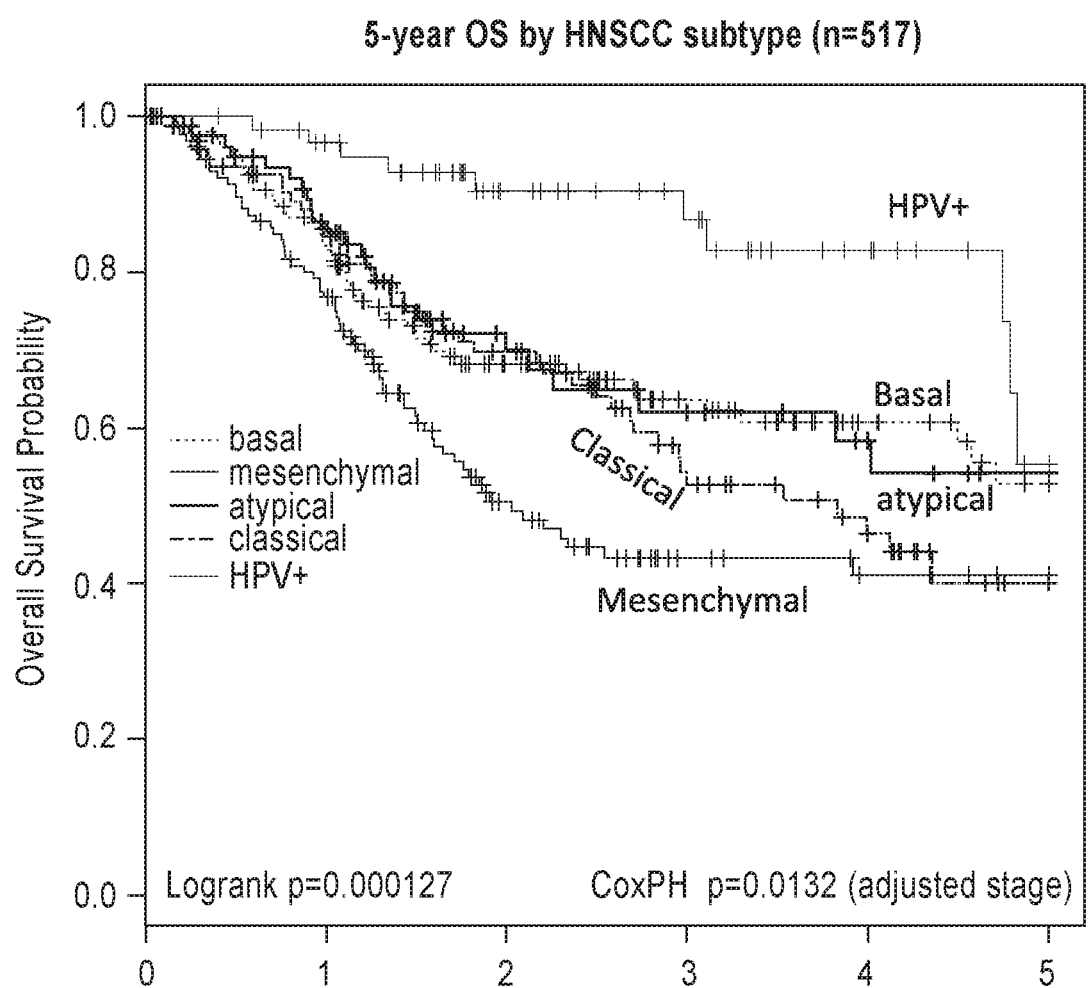
FIG. 17 illustrates survival curves comparing basal, mesenchymal, atypical, classical, and HPV positive ("Atypical-like") tumors from the TCGA dataset that were subtyped using the 144 gene set (Table 1).

In one embodiment, a method is provided herein for determining a disease outcome or prognosis for a patient suffering from cancer. In some cases, the cancer is head and neck squamous cell carcinoma. The disease outcome or prognosis can be measured by examining the overall survival for a period of time or intervals (e.g., 0 to 36 months or 0 to 60 months). In one embodiment, survival is analyzed as a function of subtype (e.g., for HNSCC (BA, MS, AT and CL)). The HNSCC subtype can be determined using the methods provided herein such as, for example, determining the expression of all or subsets of the genes in Tables 1 or 3 alone or in combination with determining the HPV status. Relapse-free and overall survival can be assessed using standard Kaplan-Meier plots as well as Cox proportional hazards modeling. For example, as shown in FIG. 17, a subject whose gene expression based HNSCC subtyping is indicative of a basal, atypical, or HPV positive ("Atypical-like") HNSCC subtype can have an overall survival that is better than a subject whose gene expression based HNSCC subtyping is indicative of an HNSCC that is mesenchymal or classical. In one embodiment, assessing the HPV status of a subject as a means of assisting in subtyping HNSCC or in conjunction with subtyping HNSCC is more predictive of said subject's prognosis than assessing HPV status alone or determining HNSCC subtype via gene expression based HNSCC subtyping without assessing HPV status. For example, as shown in FIG. 2A, a subject whose HPV status is positive and whose gene expression based HNSCC subtyping is indicative of an atypical HNSCC subtype can have an overall survival that is better than a subject whose HPV status is positive and whose gene expression based HNSCC subtyping is indicative of an HNSCC that is not atypical. The HPV status can be performed using any of the methods provided herein such as, for example, detecting the expression of one or more HPV genes (e.g., HPV E6 and/or E7 genes). The gene expression based HNSCC subtyping can be performed using any of the methods provided herein such as, for example, detecting the expression of one or more of the biomarkers listed in Tables 1 or 3.

In another embodiment, assessing the HPV status of a subject as a means of assisting in gene expression based HNSCC subtyping or in conjunction with gene expression based HNSCC subtyping is more predictive of said subject's response to a particular type of therapy (e.g., immunotherapy, radiotherapy, surgical intervention) than assessing HPV status alone or determining HNSCC subtype without assessing HPV status. The HPV status can be performed using any of the methods provided herein such as, for example, detecting the expression of one or more HPV genes (e.g., HPV E6 and/or E7 genes). The gene expression based HNSCC subtyping can be performed using any of the methods provided herein such as, for example, detecting the expression of one or more of the biomarkers listed in Tables 1 or 3.

In one embodiment, upon determining a patient's HNSCC subtype (e.g., by measuring the expression of all or subsets of the genes in Tables 1 or 3 alone or in combination with determining the HPV status), the patient is selected for suitable therapy, for example, radiotherapy (radiation therapy), surgical intervention, target therapy, chemotherapy or drug therapy with an angiogenesis inhibitor or immunotherapy or combinations thereof. In some embodiments, the suitable treatment can be any treatment or therapeutic method that can be used for a HNSCC patient. In one embodiment, upon determining a patient's HNSCC subtype, the patient is administered a suitable therapeutic agent, for example chemotherapeutic agent(s) or an angiogenesis inhibitor or immunotherapeutic agent(s). In one embodiment, the therapy is immunotherapy, and the immunotherapeutic agent is a checkpoint inhibitor, monoclonal antibody, biological response modifier, therapeutic vaccine or cellular immunotherapy. In some embodiments, the determination of a suitable treatment can identify treatment responders. In some embodiments, the determination of a suitable treatment can identify treatment non-responders. In some embodiments, upon determining a patient's HNSCC subtype, the HNSCC patients can be selected for any combination of suitable therapies. For example, chemotherapy or drug therapy with a radiotherapy, a neck dissection with an immunotherapy or a chemotherapeutic agent with a radiotherapy. In some embodiments, immunotherapy, or immunotherapeutic agent can be a checkpoint inhibitor, monoclonal antibody, biological response modifier, therapeutic vaccine or cellular immunotherapy.

The methods of present invention are also useful for evaluating clinical response to therapy, as well as for endpoints in clinical trials for efficacy of new therapies. The extent to which sequential diagnostic expression profiles move towards normal can be used as one measure of the efficacy of the candidate therapy.

In one embodiment, the methods of the invention also find use in predicting response to different lines of therapies based on the subtype of HNSCC. For example, chemotherapeutic response can be improved by more accurately assigning tumor subtypes. Likewise, treatment regimens can be formulated based on the tumor subtype.

Angiogenesis Inhibitors

In one embodiment, upon determining a patient's HNSCC subtype, the patient is selected for drug therapy with an angiogenesis inhibitor.

In one embodiment, the angiogenesis inhibitor is a vascular endothelial growth factor (VEGF) inhibitor, a VEGF receptor inhibitor, a platelet derived growth factor (PDGF) inhibitor or a PDGF receptor inhibitor.

Each biomarker panel can include one, two, three, four, five, six, seven, eight or more biomarkers usable by a classifier (also referred to as a "classifier biomarker") to assess whether a HNSCC patient is likely to respond to angiogenesis inhibitor therapy; to select a HNSCC patient for angiogenesis inhibitor therapy; to determine a "hypoxia score" and/or to subtype a HNSCC sample as basal, mesenchymal, atypical, or classical molecular subtype. As used herein, the term "classifier" can refer to any algorithm for statistical classification, and can be implemented in hardware, in software, or a combination thereof. The classifier can be capable of 2-level, 3-level, 4-level, or higher, classification, and can depend on the nature of the entity being classified. One or more classifiers can be employed to achieve the aspects disclosed herein.

In general, methods of determining whether a HNSCC patient is likely to respond to angiogenesis inhibitor therapy, or methods of selecting a HNSCC patient for angiogenesis inhibitor therapy are provided herein. In one embodiment, the method comprises assessing whether the patient's HNSCC subtype is basal, mesenchymal, atypical, or classical using the methods described herein (e.g., assessing the expression of one or more classifier biomarkers of Table 1 or Table 3 alone or in combination with assessing the expression of one or more HPV genes) and probing a HNSCC sample from the patient for the levels of at least five biomarkers selected from the group consisting of RRAGD, FABP5, UCHL1, GAL, PLOD, DDIT4, VEGF, ADM, ANGPTL4, NDRG1, NP, SLC16A3, and C14ORF58 (see Table 5) at the nucleic acid level. In a further embodiment, the probing step comprises mixing the sample with five or more oligonucleotides that are substantially complementary to portions of nucleic acid molecules of the at least five biomarkers under conditions suitable for hybridization of the five or more oligonucleotides to their complements or substantial complements, detecting whether hybridization occurs between the five or more oligonucleotides to their complements or substantial complements; and obtaining hybridization values of the sample based on the detecting steps. The hybridization values of the sample are then compared to reference hybridization value(s) from at least one sample training set, wherein the at least one sample training set comprises (i) hybridization value(s) of the at least five biomarkers from a sample that overexpresses the at least five biomarkers, or overexpresses a subset of the at least five biomarkers, (ii) hybridization values of the at least five biomarkers from a reference basal, mesenchymal, atypical, or classical sample, or (iii) hybridization values of the at least five biomarkers from a HNSCC free head and neck sample. A determination of whether the patient is likely to respond to angiogenesis inhibitor therapy, or a selection of the patient for angiogenesis inhibitor is then made based upon (i) the patient's HNSCC subtype and (ii) the results of comparison.

TABLE 5

Biomarkers for hypoxia profile

| Name | Abbreviation | GenBank Accession No. |
|---|---|---|
| RRAGD | Ras-related GTP binding D | BC003088 |
| FABP5 | fatty acid binding protein 5 | M94856 |
| UCHL1 | ubiquitin carboxyl-terminal esterase L1 | NM_004181 |
| GAL | Galanin | BC030241 |
| PLOD | procollagen-lysine, 2-oxoglutarate 5-dioxygenase lysine hydroxylase | M98252 |
| DDIT4 | DNA-damage-inducible transcript 4 | NM_019058 |
| VEGF | vascular endothelial growth factor | M32977 |
| ADM | Adrenomedullin | NM_001124 |
| ANGPTL4 | angiopoietin-like 4 | AF202636 |
| NDRG1 | N-myc downstream regulated gene 1 | NM_006096 |
| NP | nucleoside phosphorylase | NM 000270 |
| SLC16A3 | solute carrier family 16 monocarboxylic acid transporters, member 3 | NM_004207 |
| C14ORF58 | chromosome 14 open reading frame 58 | AK000378 |

The aforementioned set of thirteen biomarkers, or a subset thereof, is also referred to herein as a "hypoxia profile".

In one embodiment, the method provided herein includes determining the levels of at least five biomarkers, at least six biomarkers, at least seven biomarkers, at least eight biomarkers, at least nine biomarkers, or at least ten biomarkers, or five to thirteen, six to thirteen, seven to thirteen, eight to thirteen, nine to thirteen or ten to thirteen biomarkers selected from RRAGD, FABP5, UCHL1, GAL, PLOD, DDIT4, VEGF, ADM, ANGPTL4, NDRG1, NP, SLC16A3, and C14ORF58 in a HNSCC sample obtained from a subject. Biomarker expression in some instances may be normalized against the expression levels of all RNA transcripts or their expression products in the sample, or against a reference set of RNA transcripts or their expression products. The reference set as explained throughout, may be an actual sample that is tested in parallel with the HNSCC sample, or may be a reference set of values from a database or stored dataset. Levels of expression, in one embodiment, are reported in number of copies, relative fluorescence value or detected fluorescence value. The level of expression of the biomarkers of the hypoxia profile together with HNSCC subtype as determined using the methods provided herein can be used in the methods described herein to determine whether a patient is likely to respond to angiogenesis inhibitor therapy.

In one embodiment, the levels of expression of the thirteen biomarkers (or subsets thereof, as described above, e.g., five or more, from about five to about 13), are normalized against the expression levels of all RNA transcripts or their non-natural cDNA expression products, or protein products in the sample, or of a reference set of RNA transcripts or a reference set of their non-natural cDNA expression products, or a reference set of their protein products in the sample.

In one embodiment, angiogenesis inhibitor treatments include, but are not limited to an integrin antagonist, a selectin antagonist, an adhesion molecule antagonist, an antagonist of intercellular adhesion molecule (ICAM)-1, ICAM-2, ICAM-3, platelet endothelial adhesion molecule (PCAM), vascular cell adhesion molecule (VCAM)), lymphocyte function-associated antigen 1 (LFA-1), a basic fibroblast growth factor antagonist, a vascular endothelial growth factor (VEGF) modulator, a platelet derived growth factor (PDGF) modulator (e.g., a PDGF antagonist).

In one embodiment of determining whether a subject is likely to respond to an integrin antagonist, the integrin antagonist is a small molecule integrin antagonist, for example, an antagonist described by Paolillo et al. (Mini Rev Med Chem, 2009, volume 12, pp. 1439-1446, incorporated by reference in its entirety), or a leukocyte adhesion-inducing cytokine or growth factor antagonist (e.g., tumor necrosis factor-α (TNF-α), interleukin-1β (IL-1β), monocyte chemotactic protein-1 (MCP-1) and a vascular endothelial growth factor (VEGF), as described in U.S. Pat. No. 6,524,581, incorporated by reference in its entirety herein.

The methods provided herein are also useful for determining whether a subject is likely to respond to one or more of the following angiogenesis inhibitors: interferon gamma 1β, interferon gamma 1β (Actimmune®) with pirfenidone, ACUHTR028, aV135, aminobenzoate potassium, amyloid P, ANG1122, ANG1170, ANG3062, ANG3281, ANG3298, ANG4011, anti-CTGF RNAi, Aplidin, *Astragalus membranaceus* extract with *salvia* and *Schisandra chinensis*, atherosclerotic plaque blocker, Azol, AZX100, BB3, connective tissue growth factor antibody, CT140, danazol, Esbriet, EXC001, EXC002, EXC003, EXC004, EXC005, F647, FG3019, Fibrocorin, Follistatin, FT011, a galectin-3 inhibitor, GKT137831, GMCT01, GMCT02, GRMD01, GRMD02, GRN510, Heberon Alfa R, interferon α-2β, ITMN520, JKB119, JKB121, JKB122, KRX168, LPA1 receptor antagonist, MGN4220, MIA2, microRNA 29a oligonucleotide, MMI0100, noscapine, PBI4050, PBI4419, PDGFR inhibitor, PF-06473871, PGN0052, Pirespa, Pirfenex, pirfenidone, plitidepsin, PRM151, Px102, PYN17, PYN22 with PYN17, Relivergen, rhPTX2 fusion protein, RXI109, secretin, STX100, TGF-β Inhibitor, transforming growth factor, β-receptor 2 oligonucleotide, VA999260, XV615 or a combination thereof.

In another embodiment, a method is provided for determining whether a subject is likely to respond to one or more endogenous angiogenesis inhibitors. In a further embodiment, the endogenous angiogenesis inhibitor is endostatin, a 20 kDa C-terminal fragment derived from type XVIII collagen, angiostatin (a 38 kDa fragment of plasmin), a member of the thrombospondin (TSP) family of proteins. In a further embodiment, the angiogenesis inhibitor is a TSP-1, TSP-2, TSP-3, TSP-4 and TSP-5. Methods for determining the likelihood of response to one or more of the following angiogenesis inhibitors are also provided a soluble VEGF receptor, e.g., soluble VEGFR-1 and neuropilin 1 (NPR1), angiopoietin-1, angiopoietin-2, vasostatin, calreticulin, platelet factor-4, a tissue inhibitor of metalloproteinase (TIMP) (e.g., TIMP1, TIMP2, TIMP3, TIMP4), cartilage-derived angiogenesis inhibitor (e.g., peptide troponin I and chrondomodulin I), a disintegrin and metalloproteinase with thrombospondin motif 1, an interferon (IFN), (e.g., IFN-α, IFN-β, IFN-γ), a chemokine, e.g., a chemokine having the C-X-C motif (e.g., CXCL10, also known as interferon gamma-induced protein 10 or small inducible cytokine B10), an interleukin cytokine (e.g., IL-4, IL-12, IL-18), prothrombin, antithrombin III fragment, prolactin, the protein encoded by the TNFSF15 gene, osteopontin, maspin, canstatin, proliferin-related protein.

In one embodiment, a method for determining the likelihood of response to one or more of the following angiogenesis inhibitors is provided is angiopoietin-1, angiopoietin-2, angiostatin, endostatin, vasostatin, thrombospondin, calreticulin, platelet factor-4, TIMP, CDAI, interferon α, interferon β, vascular endothelial growth factor inhibitor (VEGI) meth-1, meth-2, prolactin, VEGI, SPARC, osteopontin, maspin, canstatin, proliferin-related protein (PRP), restin, TSP-1, TSP-2, interferon gamma 1β, ACUHTR028, αVβ5, aminobenzoate potassium, amyloid P, ANG1122, ANG1170, ANG3062, ANG3281, ANG3298, ANG4011, anti-CTGF RNAi, Aplidin, *Astragalus membranaceus* extract with *salvia* and *Schisandra chinensis*, atherosclerotic plaque blocker, Azol, AZX100, BB3, connective tissue growth factor antibody, CT140, danazol, Esbriet, EXC001, EXC002, EXC003, EXC004, EXC005, F647, FG3019, Fibrocorin, Follistatin, FT011, a galectin-3 inhibitor, GKT137831, GMCT01, GMCT02, GRMD01, GRMD02, GRN510, Heberon Alfa R, interferon α-2β, ITMN520, JKB119, JKB121, JKB122, KRX168, LPA1 receptor antagonist, MGN4220, MIA2, microRNA 29a oligonucleotide, MMI0100, noscapine, PBI4050, PBI4419, PDGFR inhibitor, PF-06473871, PGN0052, Pirespa, Pirfenex, pirfenidone, plitidepsin, PRM151, Px102, PYN17, PYN22 with PYN17, Relivergen, rhPTX2 fusion protein, RXI109, secretin, STX100, TGF-β Inhibitor, transforming growth factor, β-receptor 2 oligonucleotide, VA999260, XV615 or a combination thereof.

In yet another embodiment, the angiogenesis inhibitor can include pazopanib (Votrient), sunitinib (Sutent), sorafenib (Nexavar), axitinib (Inlyta), ponatinib (Iclusig), vandetanib (Caprelsa), cabozantinib (Cometrig), ramucirumab (Cyramza), regorafenib (Stivarga), ziv-aflibercept (Zaltrap), motesanib, or a combination thereof. In another embodiment, the angiogenesis inhibitor is a VEGF inhibitor. In a further embodiment, the VEGF inhibitor is axitinib, cabozantinib, aflibercept, brivanib, tivozanib, ramucirumab or motesanib. In yet a further embodiment, the angiogenesis inhibitor is motesanib.

In one embodiment, the methods provided herein relate to determining a subject's likelihood of response to an antagonist of a member of the platelet derived growth factor (PDGF) family, for example, a drug that inhibits, reduces or modulates the signaling and/or activity of PDGF-receptors (PDGFR). For example, the PDGF antagonist, in one embodiment, is an anti-PDGF aptamer, an anti-PDGF antibody or fragment thereof, an anti-PDGFR antibody or fragment thereof, or a small molecule antagonist. In one embodiment, the PDGF antagonist is an antagonist of the PDGFR-α or PDGFR-β. In one embodiment, the PDGF antagonist is the anti-PDGF-β aptamer E10030, sunitinib, axitinib, sorefenib, imatinib, imatinib mesylate, nintedanib, pazopanib HCl, ponatinib, MK-2461, dovitinib, pazopanib, crenolanib, PP-121, telatinib, imatinib, KRN 633, CP 673451, TSU-68, Ki8751, amuvatinib, tivozanib, masitinib, motesanib diphosphate, dovitinib dilactic acid, linifanib (ABT-869).

Upon making a determination of whether a patient is likely to respond to angiogenesis inhibitor therapy, or selecting a patient for angiogenesis inhibitor therapy, in one embodiment, the patient is administered the angiogenesis inhibitor. The angiogenesis in inhibitor can be any of the angiogenesis inhibitors described herein.

Immunotherapy

In one embodiment, provided herein is a method for determining whether a HNSCC cancer patient is likely to respond to immunotherapy by determining the subtype of HNSCC of a sample obtained from the patient and, based on the HNSCC subtype, assessing whether the patient is likely to respond to immunotherapy. In another embodiment, provided herein is a method of selecting a patient suffering from HNSCC for immunotherapy by determining a HNSCC subtype of a sample from the patient and, based on the HNSCC subtype, selecting the patient for immunotherapy. The determination of the HNSCC subtype of the sample obtained from the patient can be performed using any method for subtyping HNSCC known in the art. The determination of the HNSCC subtype of the sample obtained from the patient can be performed using any method for subtyping HNSCC provided herein. In one embodiment, the sample obtained from the patient has been previously diagnosed as being HNSCC, and the methods provided herein are used to determine the HNSCC subtype of the sample. The previous diagnosis can be based on a histological analysis. The histological analysis can be performed by one or more pathologists. In one embodiment, the HNSCC subtyping is performed via gene expression analysis of a set or panel of biomarkers or subsets thereof in order to generate an expression profile. The gene expression analysis can be performed on a head and neck cancer sample (e.g., HNSCC sample) obtained from a patient in order to determine the presence, absence or level of expression of one or more biomarkers selected from a publically available head and neck cancer database described herein and/or Table 1 or 3 provided herein. The gene expression analysis can further comprise determining the HPV status of the sample obtained from the subject. The HPV status can be assessed as provided herein (e.g., detecting the expression of one or more HPV genes). The HNSCC subtype can be selected from the group consisting of basal, atypical, mesenchymal or classical. The immunotherapy can be any immunotherapy provided herein. In one embodiment, the immunotherapy comprises administering one or more checkpoint inhibitors. The checkpoint inhibitors can be any checkpoint inhibitor provided herein such as, for example, a checkpoint inhibitor that targets PD-1, PD-LI or CTLA4.

As disclosed herein, the biomarkers panels, or subsets thereof, can be those disclosed in any publically available HNSCC gene expression dataset or datasets alone or in combination with one or more biomarkers of HPV. In one embodiment, the head and neck cancer is SCC and the biomarker panel or subset thereof is, for example, the cancer genome atlas (TCGA) HNSCC RNAseq gene expression dataset (n=520). In one embodiment, the head and neck cancer is SCC and the biomarker panel or subset thereof is, for example, the HNSCC gene expression dataset (n=134) disclosed in Keck et al. (Clin Cancer Res. 2014; 21: 870-881.), the contents of which are herein incorporated by reference in its entirety. In one embodiment, the head and neck cancer is SCC and the biomarker panel or subset thereof is, for example, the HNSCC gene expression dataset (n=138) disclosed in Von Walter et al. (PLoS One, 8(2): e56823), the contents of which are herein incorporated by reference in its entirety. In one embodiment, the head and neck cancer is SCC and the biomarker panel or subset thereof is, for example, the HNSCC gene expression dataset (n=270) disclosed in Wichman et al. (Intl Jrnl Cancer 2015; 137: 2846-2857), the contents of which are herein incorporated by reference in its entirety. In one embodiment, the head and neck cancer is SCC and the biomarker panel or subset thereof is, for example, the HNSCC gene expression dataset disclosed in Table 1 or Table 3. In one embodiment, the head and neck cancer is SCC and the biomarker panel or subset thereof is, for example, the HNSCC gene expression dataset disclosed in Table 1 or Table 3 in combination with one or more biomarkers from a publically available HNSCC expression dataset. In one embodiment, the head and neck cancer is SCC and the biomarker panel or subset thereof is, for example, the HNSCC gene expression dataset disclosed in Table 1 or Table 3 in combination with one or more biomarkers of HPV. In one embodiment, the head and neck cancer is SCC and the biomarker panel or subset thereof is, for example, the HNSCC gene expression dataset disclosed in Table 1 or Table 3 in combination with one or more biomarkers from a publically available HNSCC expression dataset and one or more biomarkers of HPV. In Table 2 or Table 4, the first column of the table represents the biomarker list for distinguishing atypical. The second column of the table represents the biomarker list for mesenchymal. The third column of the table represents the biomarker list for distinguishing classical. The last column of the table represents the biomarker list for distinguishing basal. In some cases, as shown in Table 2, a total of 144 biomarkers can be used for HNSCC subtype determination. For each HNSCC subtype in Table 2, 18 of the 36 biomarkers can be negatively correlated genes, while 18 can be positively correlated genes which can be selected as the gene signature of a specific HNSCC subtype. In some cases, as shown in Table 4, a total of 80 biomarkers can be used for HNSCC subtype determination. For each HNSCC subtype in Table 4, 10 of the 20 biomarkers can be negatively correlated genes, while 10 can be positively correlated genes which can be selected as the gene signature of a specific HNSCC subtype.

In some embodiments, the method for HNSCC subtyping includes detecting expression levels of a classifier biomarker set alone or in combination with one or more biomarkers of HPV. The classifier biomarker set can be a set of biomarkers from a publically available database such as, for example, TCGA HNSCC RNASeq gene expression dataset(s) or any other dataset provided herein. In some embodiments, the detecting includes all of the classifier biomarkers of Table 1 or Table 3 or any other dataset provided herein at the nucleic acid level or protein level. In another embodiment, a single classifier biomarker of Table 1 or Table 3 or a subset of the classifier biomarkers of Table 1 or Table 3 or any other dataset provided herein are detected, for example, from about five to about twenty. In another embodiment, a single classifier biomarker of Table 1 or a subset of the classifier biomarkers of Table 1 and/or any other dataset provided herein are detected, for example, from about 18 to about 144. In another embodiment, a single classifier biomarker of Table 3 or a subset of the classifier biomarkers of Table 3 and/or any other dataset provided herein are detected, for example, from about 10 to about 80. In another embodiment, all of the classifier biomarkers of Table 1 or Table 3 or any other dataset provided herein are detected. In another embodiment, at least one or all of the classifier biomarkers of Table 1 or Table 3 in combination with one or more classifier biomarkers of any other HNSCC dataset provided herein are detected. The detecting can be performed by any suitable technique including, but not limited to, RNA-seq, a reverse transcriptase polymerase chain reaction (RT-PCR), a microarray hybridization assay, or another hybridization assay, e.g., a NanoString assay for example, with primers and/or probes specific to the classifier biomarkers, and/or the like. In some cases, the primers useful for the amplification methods (e.g., RT-PCR or qRT-PCR) are any forward and reverse primers suitable for binding to a classifier gene from a dataset provided herein alone or in combination.

In one embodiment, from about 1 to about 5, about 5 to about 10, from about 5 to about 15, from about 5 to about 20, from about 5 to about 25, from about 5 to about 30, from about 5 to about 35, from about 5 to about 40, from about 5 to about 45, from about 5 to about 50, from about 5 to about 55, from about 5 to about 60, from about 5 to about 65, from about 5 to about 70, from about 5 to about 75, or from about 5 to about 80 of the biomarkers in any of the HNSCC gene expression datasets provided herein, including, for example, Table 1 or Table 3 for an HNSCC sample are detected in a method to determine the HNSCC subtype as provided herein. In another embodiment, each of the biomarkers from any one of the HNSCC gene expression datasets provided herein, including, for example, Table 1 or Table 3 for an HNSCC sample are detected in a method to determine the HNSCC subtype as provided herein. Further to the above embodiments, the HPV status can be determined by measuring one or more biomarkers of HPV as described herein.

In one embodiment, the methods provided herein further comprise determining the presence, absence or level of immune activation in a HNSCC subtype. The presence or level of immune cell activation can be determined by creating an expression profile or detecting the expression of one or more biomarkers associated with innate immune cells and/or adaptive immune cells associated with each HNSCC subtype in a sample obtained from a patient. In one embodiment, immune cell activation associated with a HNSCC subtype is determined by monitoring the immune cell signatures of Bindea et al (Immunity 2013; 39(4); 782-795), the contents of which are herein incorporated by reference in its entirety. In one embodiment, the method further comprises measuring single gene immune biomarkers, such as, for example, CTLA4, PDCD1 and CD274 (PD-LI), PDCDLG2 (PD-L2) and/or IFN gene signatures. The presence or a detectable level of immune activation (Innate and/or Adaptive) associated with a HNSCC subtype can indicate or predict that a patient with said HNSCC subtype may be amendable to immunotherapy. The immunotherapy can be treatment with a checkpoint inhibitor as provided herein. In one embodiment, a method is provided herein for detecting the expression of at least one classifier biomarker provided herein in a sample (e.g., HNSCC sample) obtained from a patient further comprises administering an immunotherapeutic agent following detection of immune activation as provided herein in said sample.

In one embodiment, the method comprises determining a subtype of a HNSCC sample and subsequently determining a level of immune cell activation of said sub-type. In one embodiment, the subtype is determined by determining the expression levels of one or more classifier biomarkers using sequencing (e.g., RNASeq), amplification (e.g., qRT-PCR) or hybridization assays (e.g., microarray analysis) as described herein. The one or more biomarkers can be selected from a publically available database (e.g., TCGA HNSCC RNASeq gene expression datasets or any other publically available HNSCC gene expression datasets provided herein). In some embodiments, the biomarkers of Table 1 or Table 3 can be used to specifically determine the subtype of a HNSCC sample obtained from a patient. In some embodiments, the subtyping can further comprises determining the HPV status by measuring one or more biomarkers of HPV as described herein. In some embodiments, the subtyping can be in combination with also determining the HPV status by measuring one or more biomarkers of HPV as described herein. In one embodiment, the level of immune cell activation is determined by measuring gene expression signatures of immunomarkers. The immunomarkers can be measured in the same and/or different sample used to subtype the HNSCC sample as described herein. The immunomarkers that can be measured can comprise, consist of, or consistently essentially of innate immune cell (IIC) and/or adaptive immune cell (AIC) gene signatures, interferon (IFN) gene signatures, individual immunomarkers, major histocompatability complex class II (MHC class II) genes or a combination thereof. The gene expression signatures for both IICs and AICs can be any known gene signatures for said cell types known in the art. For example, the immune gene signatures can be those from Bindea et al. (Immunity 2013; 39(4); 782-795). In one embodiment, the immunomarkers for use in the methods provided herein are selected from Table 6A and/or Table 6B. The individual immunomarkers can be CTLA4, PDCD1 and CD274 (PD-L1). In one embodiment, the individual immunomarkers for use in the methods provided herein are selected from Table 7. The immunomarkers can be one or more interferon (INF) genes. In one embodiment, the immunomarkers for use in the methods provided herein are selected from Table 8. The immunomarkers can be one or more MHCII genes. In one embodiment, the immunomarkers for use in the methods provided herein are selected from Table 9. In yet another embodiment, the immunomarkers for use in the methods provided herein are selected from Tables 6A, 6B, 7, 8, 9, or a combination thereof.

TABLE 6A

Adaptive immune cell (AIC) gene signature immunomarkers for use in the methods provided herein.

| | Cell Type | | | | | |
|---|---|---|---|---|---|---|
| | B cells | T cells | T helper cells | Tcm | Tem | Th1 cells |
| Human Gene (Gene Name; GenBank Accession No.*) | ABCB4 (ATP binding cassette subfamily B member 4; NM_000443) | BCL11B (B-cell lymphoma/ leukaemia 11B; AJ404614.1) | ANP32B (acidic nuclear phosphoprotein 32 family member B; NM_006401.2) | AQP3 (aquaporine 3; NM_004925.4) | AKT3 (AKT serine/threonine kinase 3; NM_005465.4) | APBB2 (amyloid beta precursor protein binding family B member 2; NM_001166054.1) |
| | BACH2 (BTB domain and CNC homolog 2; NM_021813.3) | CD2 (CD2 molecule; NM_001328609.1) | ASF1A (anti-silencing function 1A histone chaperone; NM_014034.2) | ATF7IP (activating transcription factor 7 interacting protein; NM_181352.1) | C7orf54 (staphylococcal nuclease and tudor domain containing 1 (SND1); NG_051199.1) | APOD (apolipoprotein D; NM_001647.3) |
| | BCL11A (B-cell CLL/ lymphoma 11A; NM_022893.3) | CD28 (CD28 molecule; NM_001243078.1) | ATF2 (activating transcription factor 2; NM_001256093.1) | ATM (ATM serine/threonine kinase; NM_000051.3) | CCR2 (C-C motif chemokine receptor 2; NM_001123396.1) | ATP9A (ATPase phospholipid transporting 9A; NM_006045.2) |
| | BLK (BLK proto-oncogene, Src family tyrosine kinase; NM_001715.2) | CD3D (CD3d molecule; NM_000732.4) | BATF (basic leucine zipper ATF-like transcription factor; NM_006399.3) | CASP8 (caspase 8; NM_001228.4) | DDX17 (DEAD-box helicase 17; NM_006386.4) | BST2 (bone marrow stromal cell antigen 2; NM_004335.3) |
| | BLNK (B-cell linker; NM_013314.3) | CD3E (CD3e molecule; NM_000733.3) | C13orf34 (aurora borealis; EU834129.1) | CDC14A (cell division cycle 14A; NM_003672.3) | EWSR1 (EWS RNA binding protein 1; NM_013986.3) | BTG3 (BTG anti-proliferation factor 3; NM_001130914.1) |
| | CCR9 (C-C motif chemokine receptor 9; NM_031200.2) | CD3G (CD3g molecule; NM_000073.2) | CD28 (CD28 molecule; NM_006139.3) | CEP68 (centrosomal protein 68; NM_015147.2) | FLI1 (Fli-1 proto-oncogene, ETS transcription factor; NM_002017.4) | CCL4 (C-C motif chemokine ligand 4; NM_002984.3) |
| | CD19 (CD19 molecule; NM_001178098.1) | CD6 (CD6 molecule; NM_006725.4) | DDX50 (DEAD-box helicase 50; NM_024045.1) | CG030 (BRCA2 region, mRNA sequence CG030; U50531.1) | GDPD5 (glycerophosphodiester phosphodiesterase domain containing 5; NM_030792.6) | CD38 (CD38 molecule; NM_001775.3) |
| | CD72 (CD72 molecule; NM_001782.2) | CD96 (CD96 molecule; NM_198196.2) | FAM111A (family with sequence similarity 111 member A; NM_022074.3) | CLUAP1 (clusterin associated protein 1; NM_015041.2) | LTK (leukocyte receptor tyrosine kinase; NM_002344.5) | CD70 (CD70 molecule; NM_001252.4) |
| | COCH (cochlin; NM_001135058.1) | GIMAP5 (GTPase, IMAP family member 5; NM_018384.4) | FRYL (FRY like transcription coactivator; NM_015030.1) | CREBZF (CREB/ATF bZIP transcription factor; NM_001039618.2) | MEFV (Mediterranean fever; NM_000243.2) | CMAH (cytidine monophospho-N-acetylneuraminic acid hydroxylase, pseudogene; NR_002174.2) |
| | CR2 (complement C3d receptor 2; NM_001006658.2) | ITM2A (integral membrane protein 2A; NM_004867.4) | FUSIP1 (serine and arginine rich splicing factor 10; NM_006625.5) | CYLD (CYLD lysine 63 deubiquitinase; NM_015247.2) | NFATC4 (nuclear factor of activated T-cells 4; NM_001136022.2) | CSF2 (colony stimulating factor 2; NM_000758.3) |
| | DTNB (dystrobrevin beta; NM_021907.4) | LCK (LCK proto-oncogene, Src family tyrosine kinase; NM_001042771.2) | GOLGA8A (golgin A8 family member A; NM_181077.3) | CYorf15B (taxilin gamma pseudogene, Y-linked; NR_045128.1) | PRKY (protein kinase, Y-linked, pseudogene; NR_028062.1) | CTLA4 (cytotoxic T-lymphocyte associated protein 4; NM_005214.4) |
| | FAM30A (family with sequence similarity 30, member A; NR_026800.2) | NCALD (neurocalcin delta; NM_001040624.1) | ICOS (inducible T-cell costimulator; NM_012092.3) | DOCK9 (dedicator of cytokinesis 9; NM_015296.2) | TBC1D5 (TBC1 domain family member 5; NM_001134381.1) | DGKI (diacylglycerol kinase iota; NM_004717.3) |
| | FCRL2 (Fc receptor like 2; NM_030764.3) | PRKCQ (protein kinase C theta; NM_006257.4) | ITM2A (integral membrane protein 2A; NM_004867.4) | FOXP1 (forkhead box P1; NM_032682.5) | TBCD (tubulin folding cofactor D; NM_005993.4) | DOK5 (docking protein 5; NM_018431.4) |
| | GLDC (glycine decarboxylase; NM_000170.2) | SH2D1A (SH2 domain containing 1A; NM_002351.4) | LRBA (LPS responsive beige-like anchor protein; NM_001199282.2) | FYB (FYN binding protein; NM_001465.4) | TRA (T cell receptor alpha delta locus; NG_001332.3) | DPP4 (dipeptidyl peptidase 4; NM_001935.3) |

TABLE 6A-continued

Adaptive immune cell (AIC) gene signature immunomarkers for use in the methods provided herein.
Cell Type

| | | | | | |
|---|---|---|---|---|---|
| GNG7 (G protein subunit gamma 7; NM_052847.2) | SKAP1 (src kinase associated phosphoprotein 1; NM_001075099.1) | NAP1L4 (nucleosome assembly protein 1 like 4; NM_005969.3) | HNRPH1 (heterogeneous nuclear ribonucleoprotein H1 (H); NM_001257293.1) | VIL2 (ezrin; NM_003379.4) | DUSP5 (dual specificity phosphatase 5; NM_004419.3) |
| HLA-DOB (major histocompatibility complex, class II, DO beta; NM_002120.3) | TRA (T cell receptor alpha delta locus; NG_001332.3) | NUP107 (nucleoporin 107; NM_020401.3) | INPP4B (inositol polyphosphate-4-phosphatase type II B; NM_003866.3) | | EGFL6 (EGF like domain multiple 6; NM_015507.3) |
| HLA-DQA1 (major histocompatibility complex, class II, DQ alpha 1; NM_002122.3) | TRAC (nuclear receptor corepressor 2; NM_006312.5) | PHF10 (PHD finger protein 10; NM_018288.3) | KLF12 (Kruppel like factor 12; NM_007249.4) | | GGT1 (gamma-glutamyltransferase 1; NM_013421.2) |
| IGHA1 (immunoglobulin heavy locus; NG_001019.6) | TRAT1 (T cell receptor associated transmembrane adaptor 1; NM_016388.3) | PPP2R5C (protein phosphatase 2 regulatory subunit B', gamma; NM_001161725.1) | LOC202134 (family with sequence similarity 153 member B; NM_001265615.1) | | HBEGF (heparin binding EGF like growth factor; NM_001945.2) |
| IGHG1 (immunoglobulin heavy locus; NG_001019.6) | TRBC1 (T cell receptor beta locus; NG_001333.2) | RPA1 (replication protein A1; NM_002945.3) | MAP3K1 (mitogen-activated protein kinase kinase kinase 1, E3 ubiquitin protein ligase; NM_005921.1) | | IFNG (interferon gamma; NM_000619.2) |
| IGHM (immunoglobulin heavy locus; NG_001019.6) | | SEC24C (SEC24 homolog C, COPII coat complex component; NM_004922.3) | MLL (lysine (K)-specific methyltransferase 2A; NM_005933.3) | | IL12RB2 (interleukin 12 receptor subunit beta 2; NM_001319233.1) |
| IGKC (immunoglobulin kappa locus, proximal V-cluster and J-C cluster; NG_000834.1) | | SLC25A12 (solute carrier family 25 member 12; NM_003705.4) | NEFL (neurofilament, light polypeptide; NM_006158.4) | | IL22 (interleukin 22; NM_020525.4) |
| IGL (immunoglobulin lambda locus; NG_000002.1) | | TRA (T cell receptor alpha delta locus; NG_001332.3) | NFATC3 (nuclear factor of activated T-cells 3; NM_173165.2) | | LRP8 (LDL receptor related protein 8; NM_017522.4) |
| KIAA0125 (family with sequence similarity 30, member A; NR_026800.2) | | UBE2L3 (ubiquitin conjugating enzyme E2 L3; NM_003347.3) | PCM1 (pericentriolar material 1; NM_001315507.1) | | LRRN3 (leucine rich repeat neuronal 3; NM_018334.4) |
| MEF2C (myocyte enhancer factor 2C; NM_001308002.1) | | YME1L1 (YME1 like 1 ATPase; NM_001253866.1) | PCNX (pecanex homolog 1; NM_014982.2) | | LTA (lymphotoxin alpha; NM_000595.3) |
| MICAL3 (microtubule associated monooxygenase, calponin and LIM domain containing 3; NM_001136004.3) | | | PDXDC2 (pyridoxal dependent decarboxylase domain containing 2, pseudogene; NR_003610.1) | | SGCB (sarcoglycan, beta (43 kDa dystrophin-associated glycoprotein); NM_000232.4) |
| MS4A1 (membrane spanning 4-domains A1; NM_021950.3) | | | PHC3 (polyhomeotic homolog 3; NM_001308116.1) | | SYNGR3 (synaptogyrin 3; NM_004209.5) |
| OSBPL10 (oxysterol binding protein like 10; NM_017784.4) | | | POLR2J2 (RNA polymerase II subunit J2; NM_032959.5) | | ZBTB32 (zinc finger and BTB domain containing 32; NM_014383.2) |

TABLE 6A-continued

Adaptive immune cell (AIC) gene signature immunomarkers for use in the methods provided herein.
Cell Type PNOC (prepronociceptin; NM_001284244.1)
QRSL1 (glutaminyl-tRNA synthase (glutamine-hydrolyzing)-like 1; NM_018292.4)
SCN3A (sodium voltage-gated channel alpha subunit 3; NM_001081677.1)
SLC15A2 (solute carrier family 15 member 2; XM_017007074.1)
SPIB (Spi-B transcription factor; NM_001244000.1)
TCL1A (T-cell leukemia/lymphoma 1A; NM_001098725.1)
TNFRSF17 (TNF receptor superfamily member 17; NM_001192.2)

PSPC1 (paraspeckle component 1; NM_001042414.2)
REPS1 (RALBP1 associated Eps domain containing 1; NM_001128617.2)

RP11-74E24.2 (zinc finger CCCH-type domain-containing-like; NM_001271675.1)
RPP38 (ribonuclease P/MRP subunit p38; NM_001265601.1)

SLC7A6 (solute carrier family 7 member 6; NM_003983.5)
SNRPN (small nuclear ribonucleoprotein polypeptide N; NM_022807.3)
ST3GAL1 (ST3 beta-galactoside alpha-2,3-sialyltransferase 1; NM_173344.2)

STX16 (syntaxin 16; NM_001204868.1)
TIMM8A (translocase of inner mitochondrial membrane 8 homolog A; NM_001145951.1)
TRAF3IP3 (TRAF3 interacting protein 3; NM_001320144.1)
TXK (TXK tyrosine kinase; NM_003328.2)
USP9Y (ubiquitin specific peptidase 9, Y-linked; NG_008311.1)

| | Th2 cells | TFH | Th17 cells | TReg |
|---|---|---|---|---|
| Human Gene (Gene Name; GenBank Accession No.*) | ADCY1 (adenylate cyclase 1; NM_001281768.1) | B3GAT1 (beta-1,3-glucuronyl-transferase 1; NM_018644.3) | IL17A (interleukin 17A; NM_002190.2) | FOXP3 (forkhead box P3; NM_014009.3) |
| | AHI1 (Abelson helper integration site 1; NM_001134831.1) | BLR1 (c-x-c chemokine receptor type 5; EF444957.1) | IL17RA (interleukin 17 receptor A; NM_014339.6) | |
| | AI582773 (tn17d08.x1 NCI_CGAP_Brn25 *Homo sapiens* cDNA clone; AI582773.1) | C18orf1 (low density lipoprotein receptor class A domain containing 4; NM_181481.4) | RORC (RAR related orphan receptor C; NM_001001523.1) | |

TABLE 6A-continued

Adaptive immune cell (AIC) gene signature immunomarkers for use in the methods provided herein.
Cell Type ANK1 (ankyrin 1; NM_020476.2)

BIRC5 (baculoviral IAP repeat containing 5; NM_001012271.1)

CDC25C (cell division cycle 25C; NM_001318098.1)

CDC7 (cell division cycle 7; NM_001134420.1)

CENPF (centromere protein F; NM_016343.3)

CXCR6 (killer cell lectin like receptor B1; NM_002258.2)

DHFR (dihydrofolate reductase; NM_001290354.1)

EVI5 (ecotropic viral integration site 5; NM_001308248.1)

GATA3 (GATA binding protein 3; NM_001002295.1)

GSTA4 (glutathione S-transferase alpha 4; NM_001512.3)

HELLS (helicase, lymphoid-specific; NM_001289074.1)

IL26 (interleukin 26; NM_018402.1)

LAIR2 (leukocyte associated immunoglobulin like receptor 2; NM_021270.4)

LIMA1 (LIM domain and actin binding 1; NM_001243775.1)

MB (myoglobin; NM_203377.1)

CDK5R1 (cyclin dependent kinase 5 regulatory subunit 1; NM_003885.2)

CHGB (chromogranin B; NM_001819.2)

CHI3L2 (chitinase 3 like 2; NM_001025199.1)

CXCL13 (C-X-C motif chemokine ligand 13; NM_006419.2)

HEY1 (hes related family bHLH transcription factor with YRPW motif 1; NM_001282851.1)

HIST1H4K (histone cluster 1 H4 family member k; NM_003541.2)

ICA1 (islet cell autoantigen 1; NM_001136020.2)

KCNK5 (potassium two pore domain channel subfamily K member 5; NM_003740.3)

KIAA1324 (KIAA1324; NM_001284353.1)

MAF (MAF bZIP transcription factor; NM_001031804.2)

MAGEH1 (MAGE family member H1; NM_014061.4)

MKL2 (MKL1/myocardin like 2; NM_014048.4)

MYO6 (myosin VI; NM_001300899.1)

MYO7A (myosin VIIA; NM_001127179.2)

PASK (PAS domain containing serine/threonine kinase; NM_001252119.1)

TABLE 6A-continued

Adaptive immune cell (AIC) gene signature immunomarkers for use in the methods provided herein.
Cell Type

| | | |
|---|---|---|
| MICAL2 (microtubule associated monooxygenase, calponin and LIM domain containing 2; NM_001282663.1) | PDCD1 (programmed cell death 1; NM_005018.2) | |
| NEIL3 (nei like DNA glycosylase 3; NM_018248.2) | POMT1 (protein O-mannosyl-transferase 1; NM_001136114.1) | |
| PHEX (phosphate regulating endopeptidase homolog, X-linked; NM_000444.5) | PTPN13 (protein tyrosine phosphatase, non-receptor type 13; NM_080685.2) | |
| PMCH (pro-melanin concentrating hormone; NM_002674.3) | PVALB (parvalbumin; NM_001315532.1) | |
| PTGIS (I2 synthase; NM_000961.3) | SH3TC1 (SH3 domain and tetratricopeptide repeats 1; NM_018986.4) | |
| SLC39A14 (solute carrier family 39 member 14; NM_001135153.1) | SIRPG (signal regulatory protein gamma; NM_018556.3) | |
| SMAD2 (SMAD family member 2; NM_001135937.2) | SLC7A10 (solute carrier family 7 member 10; NM_019849.2) | |
| SNRPD1 (small nuclear ribonucleoprotein D1 polypeptide; NM_001291916.1) | SMAD1 (SMAD family member 1; NM_001003688.1) | |
| WDHD1 (WD repeat and HMG-box DNA binding protein 1; NM_001008396.2) | ST8SIA1 (ST8 alpha-N-acetyl-neuraminide alpha-2,8-sialyltransferase 1; NM_001304450.1) | |
| | STK39 (serine/threonine kinase 39; NM_013233.2) | |
| | THADA (THADA, armadillo repeat containing; NM_001271644.1) | |
| | TOX (thymocyte selection associated high mobility group box; NM_014729.2) | |
| | TSHR (thyroid stimulating hormone receptor; NM_000369.2) | |
| | ZNF764 (zinc finger protein 764; NM_001172679.1) | |

TABLE 6A-continued

Adaptive immune cell (AIC) gene signature immunomarkers for use in the methods provided herein.
Cell Type

| | | CD8 T cells | Tgd | Cytotoxic cells |
|---|---|---|---|---|
| | Human Gene (Gene Name; GenBank Accession No.*) | ABT1 (activator of basal transcription 1; NM_013375.3) AES (amino-terminal enhancer of split; NM_198969.1) APBA2 (amyloid beta precursor protein binding family A member 2; NM_001130414.1) ARHGAP8 (Rho GTPase activating protein 8; NM_001198726.1) C12orf47 (MAPKAPK5 antisense RNA 1; NR_015404.1) C19orf6 (transmembrane protein 259; NM_001033026.1) C4orf15 (HAUS augmin like complex subunit 3; NM_001303143.1) CAMLG (calcium modulating ligand; NM_001745.3) CD8A (CD8a molecule; NM_001768.6) CD8B (CD8b molecule; NM_001178100.1) CDKN2AIP (CDKN2A interacting protein; NM_001317343.1) DNAJB1 (DnaJ heat shock protein family (Hsp40) member B1; NM_001313964.1) FLT3LG (fms related tyrosine kinase 3 ligand; NM_001278638.1) GADD45A (growth arrest and DNA damage inducible alpha; NM_001199742.1) GZMM (granzyme M; NM_001258351.1) | C1orf61 (chromosome 1 open reading frame 61; NM_006365.2) CD160 (CD160 molecule; NM_007053.3) FEZ1 (Fasciculation And Elongation Protein Zeta 1; AF123659.1) TARP (TCR gamma alternate reading frame protein; NM_001003806.1) TRD (T cell receptor alpha delta locus; NG_001332.3) TRGV9 (Tcell receptor gamma V region 9; X69385.1) | APBA2 (amyloid beta precursor protein binding family A member 2; NM_005503.3) APOL3 (apolipoprotein L3; NM_014349.2) CTSW (cathepsin W; NM_001335.3) DUSP2 (dual specificity phosphatase 2; NM_004418.3) GNLY (granulysin; NM_012483.3) GZMA (granzyme A; NM_006144.3) GZMH (granzyme H; NM_001270781.1) KLRB1 (killer cell lectin like receptor B1; NM_002258.2) KLRD1 (killer cell lectin like receptor D1; NM_001114396.1) KLRF1 (killer cell lectin like receptor F1; NM_001291822.1) KLRK1 (killer cell lectin like receptor K1; NM_007360.3) NKG7 (natural killer cell granule protein 7; NM_005601.3) RORA (RAR related orphan receptor A; NM_134262.2) RUNX3 (runt related transcription factor 3; NM_004350.2) SIGIRR (single Ig and TIR domain containing; NM_001135054.1) |

TABLE 6A-continued

Adaptive immune cell (AIC) gene signature immunomarkers for use in the methods provided herein.
Cell Type

| | | |
|---|---|---|
| | KLF9 (Kruppel like factor 9; NM_001206.2) | WHDC1L1 (WAS protein homolog associated with actin, golgi membranes and microtubules pseudogene 3; NR_003521.1) |
| | LEPROTL1 (leptin receptor overlapping transcript-like 1; NM_001128208.1) | ZBTB16 (zinc finger and BTB domain containing 16; NM_001018011.1) |
| | LIME1 (Lck interacting transmembrane adaptor 1; NM_017806.3) | |
| | MYST3 (MYST histone acetyl-transferase (monocytic leukemia) 3; NM_006766.4) | |
| | PF4 (platelet factor 4; NM_002619.3) | |
| | PPP1R2 (protein phosphatase 1 regulatory inhibitor subunit 2; NM_001291504.1) | |
| | PRF1 (perforin 1; NM_005041.4) | |
| | PRR5 (proline rich 5; NM_181333.3) | |
| | RBM3 (RNA binding motif (RNP1, RRM) protein 3; NM_006743.4) | |
| | SF1 (splicing factor 1; NM_004630.3) | |
| | SFRS7 (serine and arginine rich splicing factor 7; NM_001031684.2) | |
| | SLC16A7 (solute carrier family 16 member 7; NM_001270622.1) | |
| | TBCC (tubulin folding cofactor C; NM_003192.2) | |
| | THUMPD1 (THUMP domain containing 1; NM_017736.4) | |

TABLE 6A-continued

Adaptive immune cell (AIC) gene signature immunomarkers for use in the methods provided herein.
Cell Type

|   |   |
|---|---|
|   | TMC6 (transmembrane channel like 6; NM_001321185.1) |
|   | TSC22D3 (TSC22 domain family member 3; NM_001318470.1) |
|   | VAMP2 (vesicle associated membrane protein 2; NM_014232.2) |
|   | ZEB1 (zinc finger E-box binding homeobox 1; NM_001128128.2) |
|   | ZFP36L2 (ZFP36 ring finger protein like 2; NM_006887.4) |
|   | ZNF22 (zinc finger protein 22; NM_006963.4) |
|   | ZNF609 (zinc finger protein 609; NM_015042.1) |
|   | ZNF91 (zinc finger protein 91; NM_001300951.1) |

*Each GenBank Accession Number is a representative or exemplary GenBank Accession Number for the listed gene and is herein incorporated by reference in its entirety for all purposes. Further, each listed representative or exemplary accession number should not be construed to limit the claims to the specific accession number.

TABLE 6B

Innate immune cell (IIC) gene signature immunomarkers for use in the methods provided herein.
Cell Type

|   | NK cells | NK CD56dim cells | NK CD56bright cells |
|---|---|---|---|
| Human Gene (Gene Name; GenBank Accession No.*) | ADARB1 (adenosine deaminase, RNA specific B1; NM_001112) | EDG8 (sphingosine-1-phosphate receptor 5; NM_001166215.1) | BG255923 (lysophosphatidylcholine acyltransferase 4; NM_153613.2) |
|   | AF107846 (neuroendocrine-specific Golgi protein p55; AF107846.1) | FLJ20699 (cDNA FLJ20699 fis, clone KAIA2372; AK000706.1) | DUSP4 (dual specificity phosphatase 4; NM_057158.3) |
|   | AL080130 (cDNA DKFZp434E033 (from clone DKFZp434E033); AL080130.1) | GTF3C1 (general transcription factor IIIC subunit 1; NM_001286242.1) | FOXJ1 (forkhead box J1; NM_001454.3) |
|   | ALDH1B1 (aldehyde dehydrogenase 1 family member B1; NM_000692.4) | GZMB (granzyme B; NM_004131.4) | MADD (MAP kinase activating death domain; NM_001135944.1) |
|   | ARL6IP2 (atlastin GTPase 2; NM_001330461.1) | IL21R (interleukin 21 receptor; NM_181079.4) | MPPED1 (metallophosphoesterase domain containing 1, mRNA; NM_001044370.1) |
|   | BCL2 (apoptosis regulator (BCL2); NM_000633.2) | KIR2DL3 (killer cell immunoglobulin like receptor, two Ig domains and long cytoplasmic tail 3; NM_015868.2) | MUC3B (mucin 3B cell surface associated; JQ511939.1) |

TABLE 6B-continued

Innate immune cell (IIC) gene signature immunomarkers for use in the methods provided herein.
Cell Type

| | | |
|---|---|---|
| CDC5L (cell division cycle 5 like; NM_001253.3) | KIR2DS1 (killer cell immunoglobulin like receptor, two Ig domains and short cytoplasmic tail 1; NM_014512.1) | NIBP (NIK and IKKbetta-binding protein; AY630619.1) |
| FGF18 (fibroblast growth factor 18; NM_003862.2) | KIR2DS2 (killer cell immunoglobulin like receptor, two Ig domains and short cytoplasmic tail 2; NM_001291700.1) | PLA2G6 (phospholipase A2 group VI; NM_001004426.1) |
| FUT5 (fucosyltransferase 5; NM_002034.2) | KIR2DS5 (killer cell immunoglobulin like receptor, two Ig domains and short cytoplasmic tail 5; NM_014513.2) | RRAD (Ras related glycolysis inhibitor and calcium channel regulator; NM_001128850.1) |
| FZR1 (fizzy/cell division cycle 20 related 1; XM_005259573.4) | KIR3DL1 (killer cell immunoglobulin like receptor, three Ig domains and long cytoplasmic tail 1; NM_013289.2) | SEPT6 (septin 6; NM_145802.3) |
| GAGE2 (G antigen 2; NM_001127212.1) | KIR3DL2 (killer cell immunoglobulin like receptor, three Ig domains and long cytoplasmic tail 2; NM_006737.3) | XCL1 (X-C motif chemokine ligand 1; NM_002995.2) |
| IGFBP5 (insulin like growth factor binding protein 5; NM_000599.3) | KIR3DL3 (killer cell immunoglobulin like receptor, three Ig domains and long cytoplasmic tail 3; NM_153443.4) | |
| LDB3 (LIM domain binding 3; NM_001171611.1) | KIR3DS1 (killer cell immunoglobulin like receptor, three Ig domains and short cytoplasmic tail 1; NM_001083539.2) | |
| LOC643313 (similar to hypothetical protein LOC284701; XM_933043.1) | SPON2 (spondin 2; NM_001199021.1) | |
| LOC730096 (hypothetical protein LOC730096; NC_000022.9) | TMEPAI (prostate transmembrane protein, androgen induced 1; NM_199169.2) | |
| MAPRE3 (microtubule associated protein RP/EB family member 3; NM_001303050.1) | | |
| MCM3AP (minichromosome maintenance complex component 3 associated protein; NM_003906.4) | | |
| MRC2 (mannose receptor C type 2; NM_006039.4) | | |
| NCR1 (natural cytotoxicity triggering receptor 1; NM_001242357.2) | | |
| NM_014114 (PR00097 protein; NM_014114.1) | | |
| NM_014274 (transient receptor potential cation channel, subfamily V, member 6; NM_014274.3) | | |
| NM_017616 (KN motif and ankyrin repeat domains 2; NM_015493.6) | | |
| PDLIM4 (PDZ and LIM domain 4; NM_003687.3) | | |
| PRX (periaxin; | | |

TABLE 6B-continued

Innate immune cell (IIC) gene signature immunomarkers for use in the methods provided herein.
Cell Type NM_020956.2)
PSMD4 (proteasome 26S subunit, non-ATPase 4; NM_001330692.1)
RP5-886K2.1 (neuronal thread protein AD7c-NTP; AF010144.1)
SLC30A5 (solute carrier family 30 member 5; NM_001251969.1)
SMEK1 (protein phosphatase 4 regulatory subunit 3A; NM_001284280.1)
SPN (sialophorin; NM_003123.4)
TBXA2R (thromboxane A2 receptor; NM_001060.5)
TCTN2 (tectonic family member 2; NM_001143850.2)
TINAGL1 (tubulointerstitial nephritis antigen like 1; NM_001204415.1)
XCL1 (X-C motif chemokine ligand 1; NM_002995.2)
XCL2 (X-C motif chemokine ligand 2; NM_003175.3)
ZNF205 (zinc finger protein 205; NM_001278158.1)
ZNF528 (zinc finger protein 528; NM_032423.2)
ZNF747 (zinc finger protein 747; NM_023931.3)

|  | DC | iDC |
|---|---|---|
| Human Gene (Gene Name; GenBank Accession No.*) | CCL13 (C-C motif chemokine ligand 13; NM_005408.2) | ABCG2 (ATP-binding cassette, sub-family G (WHITE), member 2 (Junior blood group); NM_001257386.1) |
|  | CCL17 (C-C motif chemokine ligand 17; NM_002987.2) | BLVRB (biliverdin reductase B; NM_000713.2) |
|  | CCL22 (C-C motif chemokine ligand 22; NM_002990.4) | CARD9 (caspase recruitment domain family member 9; NM_052814.3) |
|  | CD209 (CD209 molecule; NM_001144899.1) | CD1A (CD1a molecule; NM_001763.2) |
|  | HSD11B1 (hydroxysteroid 11-beta dehydrogenase 1; NM_001206741.1) | CD1B (CD1b molecule; NM_001764.2) |
|  | NPR1 (natriuretic peptide receptor 1; NM_000906.3) | CD1C (CD1c molecule; NM_001765.2) |
|  | PPFIBP2 (PPFIA binding protein 2; XR_930917.2) | CD1E (CD1e molecule; NM_001185115.1) |
|  |  | CH25H (cholesterol 25-hydroxylase; NM_003956.3) |
|  |  | CLEC10A (C-type lectin domain family 10 member A; NM_001330070.1) |
|  |  | CSF1R (colony stimulating factor 1 receptor; NM_001288705.1) |
|  |  | CTNS (cystinosin, lysosomal cystine transporter; NM_001031681.2) |
|  |  | F13A1 (factor XIII a subunit; AH002691.2) |
|  |  | FABP4 (fatty acid binding protein 4; NM_001442.2) |

TABLE 6B-continued

Innate immune cell (IIC) gene signature immunomarkers for use in the methods provided herein.
Cell Type

| | | | |
|---|---|---|---|
| | | | FZD2 (frizzled class receptor 2; NM_001466.3) GSTT1 (glutathione S-transferase theta 1; NM_001293814.1) GUCA1A (guanylate cyclase activator 1A; NM_001319062.1) HS3ST2 (heparan sulfate (glucosamine) 3-O-sulfotransferase 2; NM_006043.1) LMAN2L (lectin, mannose binding 2 like; NM_001322355.1) MMP12 (matrix metallopeptidase 12; NM_002426.5) MS4A6A (membrane spanning 4-domains A6A; NM_001330275.1) NM_021941 (chromosome 21 open reading frame 97; NM_021941.1) NUDT9 (nudix hydrolase 9; NM_001248011.1) PPARG (peroxisome proliferator activated receptor gamma; NM_005037.5) PREP (prolyl endopeptidase; NM_002726.4) RAP1GAP (RAP1 GTPase activating protein; NM_001330383.1) SLC26A6 (solute carrier family 26 member 6; NM_001281733.1) SLC7A8 (solute carrier family 7 member 8; NR_049767.1) SYT17 (synaptotagmin 17; NM_001330509.1) TACSTD2 (tumor-associated calcium signal transducer 2; NM_002353.2) TM7SF4 (dendrocyte expressed seven transmembrane protein; NM_001257317.1) VASH1 (vasohibin 1; NM_014909.4) | |
| | aDC | pDC | Eosinophils |
| Human Gene (Gene Name; GenBank Accession No.*) | CCL1 (Chemokine (C-C motif) ligand 1; NM_002981) EBI3 (Epstein-Barr virus induced 3; NM_005755.2) INDO (indoleamine-pyrrole 2,3 dioxygenase; AY221100.1) LAMP3 (lysosomal associated membrane protein 3; NM_014398.3) | IL3RA (interleukin 3 receptor subunit alpha; NM_001267713.1) | ABHD2 (abhydrolase domain containing 2; NM_007011.7) ACACB (acetyl-CoA carboxylase beta; NM_001093.3) C9orf156 (tRNA methyltransferase O; NM_001330725.1) CAT (catalase; NM_001752.3) |

TABLE 6B-continued

Innate immune cell (IIC) gene signature immunomarkers for use in the methods provided herein.
Cell Type

| | |
|---|---|
| OAS3 (2'-5'-oligoadenylate synthetase 3; NM_006187.3) | CCR3 (C-C motif chemokine receptor 3; NM_178329.2) |
| | CLC (Charcot-Leyden crystal galectin; NM_001828.5) |
| | CYSLTR2 (cysteinyl leukotriene receptor 2; NM_001308471.1) |
| | EMR1 (EGF-like module containing mucin-like hormone receptor-like 1; DQ217942.1) |
| | EPN2 (epsin 2; NM_001102664.1) |
| | GALC (galactosylceramidase; NM_000153.3) |
| | GPR44 (orphan G protein-coupled receptor; AF118265.1) |
| | HES1 (hes family bHLH transcription factor 1; NM_005524.3) |
| | HIST1H1C (histone cluster 1 H1 family member c; NM_005319.3) |
| | HRH4 (histamine receptor H4; NM_001143828.1) |
| | IGSF2 (immunoglobulin superfamily, member 2; BC130327.1) |
| | IL5RA (interleukin 5 receptor subunit alpha; NM_001243099.1) |
| | KBTBD11 (kelch repeat and BTB domain containing 11; NM_014867.2) |
| | KCNH2 (potassium voltage-gated channel, subfamily H (eag-related), member 2; NM_000238.3) |
| | LRP5L (LDL receptor related protein 5 like; NM_001135772.1) |
| | MYO15B (myosin XVB; NM_001309242.1) |
| | RCOR3 (REST corepressor 3; NM_001136224.2) |
| | RNASE2 (ribonuclease A family member 2; NM_002934.2) |
| | RNU2 (U2 snRNA; U57614.1) |
| | RRP12 (ribosomal RNA processing 12 homolog; NM_001284337.1) |
| | SIAH1 (siah E3 ubiquitin protein ligase 1; NM_003031.3) |
| | SMPD3 (sphingomyelin phosphodiesterase 3; NM_018667.3) |
| | SYNJ1 (synaptojanin 1; NM_001160302.1) |

TABLE 6B-continued

Innate immune cell (IIC) gene signature immunomarkers for use in the methods provided herein.
Cell Type

| | | | TGIF1 (TGFB induced factor homeobox 1; NM_174886.2) THBS1 (thrombospondin 1; NM_003246.3) THBS4 (thrombospondin 4; NM_001306213.1) TIPARP (TCDD inducible poly(ADP-ribose) polymerase; NM_001184718.1) TKTL1 (transketolase like 1; NM_001145934.1) |
|---|---|---|---|
| | Macrophages | Mast cells | Neutrophils |
| Human Gene (Gene Name; GenBank Accession No.*) | APOE (apolipoprotein E; NM_001302691.1) | ABCC4 (ATP binding cassette subfamily C member 4; NM_001301829.1) | ALPL (alkaline phosphatase, liver/bone/kidney; NM_001127501.3) |
| | ATG7 (autophagy related 7; NM_001144912.1) | ADCYAP1 (adenylate cyclase activating polypeptide 1; NM_001117.4) | BST1 (bone marrow stromal cell antigen 1; NM_004334.2) |
| | BCAT1 (branched chain amino acid transaminase 1; NM_001178094.1) | CALB2 (calbindin 2; NM_001740.4) | CD93 (CD93 molecule; NM_012072.3) |
| | CCL7 (C-C motif chemokine ligand 7; NM_006273.3) | CEACAM8 (carcinoembryonic antigen related cell adhesion molecule 8; NM_001816.3) | CEACAM3 (carcinoembryonic antigen related cell adhesion molecule 3; NM_001277163.2) |
| | CD163 (CD163 molecule; NM_203416.3) | CMA1 (chymase 1, mast cell; NM_001308083.1) | CREB5 (cAMP responsive element binding protein 5; NM_001011666.2) |
| | CD68 (CD68 molecule; NM_001040059.1) | CPA3 (carboxypeptidase A3; NM_001870.3) | CRISPLD2 (cysteine rich secretory protein LCCL domain containing 2; NM_031476.3) |
| | CD84 (CD84 molecule; NM_001184881.1) | CTSG (cathepsin G; NM_001911.2) | CSF3R (colony stimulating factor 3 receptor; NM_172313.2) |
| | CHI3L1 (chitinase 3 like 1; NM_001276.2) | ELA2 (neutrophil elastase; EU617980.1) | CYP4F3 (cytochrome P450 family 4 subfamily F member 3; NM_001199209.1) |
| | CHIT1 (chitinase 1; NM_001270509.1) | GATA2 (GATA binding protein 2; NM_001145661.1) | DYSF (dysferlin; NM_001130455.1) |
| | CLEC5A (C-type lectin domain family 5 member A; NM_001301167.1) | HDC (histidine decarboxylase; NM_002112.3) | FCAR (Fc fragment of IgA receptor; NM_133278.3) |
| | COL8A2 (collagen type VIII alpha 2 chain; NM_001294347.1) | HPGD (hydroxyprostaglandin dehydrogenase 15-(NAD); NM_001256307.1) | FCGR3B (Fc fragment of IgG receptor IIIb; NM_001271035.1) |

TABLE 6B-continued

Innate immune cell (IIC) gene signature immunomarkers for use in the methods provided herein.
Cell Type

| | | |
|---|---|---|
| COLEC12 (collectin subfamily member 12; NM_130386.2) | KIT (KIT proto-oncogene receptor tyrosine kinase; NM_000222.2) | FLJ11151 (hypothetical protein FLJ11151; BC006289.2) |
| CTSK (cathepsin K; NM_000396.3) | LOC339524 (long intergenic non-protein coding RNA 1140; NR_026985.1) | FPR1 (formyl peptide receptor 1; NM_001193306.1) |
| CXCL5 (C-X-C motif chemokine ligand 5; NM_002994.4) | LOH11CR2A (BCSC-1 isoform; AY366508.1) | FPRL1 (formyl peptide receptor-like receptor; M84562.1) |
| CYBB (cytochrome b-245 beta chain; NM_000397.3) | MAOB (monoamine oxidase B; NM_000898.4) | G0S2 (G0/G1 switch 2; NM_015714.3) |
| DNASE2B (deoxyribonuclease 2 beta; NM_058248.1) | MLPH (melanophilin; NM_001042467.2) | HIST1H2BC (histone cluster 1 H2B family member c; NM_003526.2) |
| EMP1 (epithelial membrane protein 1; NM_001423.2) | MPO (myeloperoxidase; NM_000250.1) | HPSE (heparanase; NM_001098540.2) |
| FDX1 (ferredoxin 1; NM_004109.4) | MS4A2 (membrane spanning 4-domains A2; NM_001256916.1) | IL8RA (interleukin 8 receptor alpha; L19591.1) |
| FN1 (fibronectin 1; NM_001306131.1) | NM_003293 (tryptase alpha/beta 1; NM_003294.3) | IL8RB (interleukin-8 receptor type B; U11878.1) |
| GM2A (GM2 ganglioside activator; NM_000405.4) | NR0B1 (nuclear receptor subfamily 0 group B member 1; NM_000475.4) | KCNJ15 (potassium voltage-gated channel subfamily J member 15; NM_001276438.1) |
| GPC4 (glypican 4; NM_001448.2) | PGDS (hematopoietic prostaglandin D synthase; NM_014485.2) | KIAA0329 (tectonin beta-propeller repeat containing 2; NM_014844.4) |
| KAL1 (anosmin 1; NM_000216.3) | PPM1H (protein phosphatase, Mg2+/Mn2+ dependent 1H; NM_020700.1) | LILRB2 (leukocyte immunoglobulin like receptor B2; NR_103521.2) |
| MARCO (macrophage receptor with collagenous structure; NM_006770.3) | PRG2 (proteoglycan 2, pro eosinophil major basic protein; NM_001302927.1) | MGAM (maltase-glucoamylase; NM_004668.2) |
| ME1 (malic enzyme 1; NM_002395.5) | PTGS1 (prostaglandin-endoperoxide synthase 1; NM_000962.3) | MME (membrane metalloendopeptidase; NM_007289.2) |
| MS4A4A (membrane spanning 4-domains A4A; NM_001243266.1) | SCG2 (secretogranin II; NM_003469.4) | PDE4B (phosphodiesterase 4B; NM_001297440.1) |
| MSR1 (macrophage scavenger receptor 1; NM_138716.2) | SIGLEC6 (sialic acid binding Ig like lectin 6; NM_198845.5) | S100A12 (S100 calcium binding protein A12; NM_005621.1) |
| PCOLCE2 (procollagen C-endopeptidase enhancer 2; NM_013363.3) | SLC18A2 (solute carrier family 18 member A2; NM_003054.4) | SIGLEC5 (sialic acid binding Ig like lectin 5; NM_003830.3) |
| PTGDS (prostaglandin | SLC24A3 (solute carrier family 24 | SLC22A4 (solute carrier |

TABLE 6B-continued

Innate immune cell (IIC) gene signature immunomarkers for use in the methods provided herein.
Cell Type

| | | |
|---|---|---|
| D2 synthase; NM_000954.5) | member 3; NM_020689.3) | family 22 member 4; NM_003059.2) |
| RAI14 (retinoic acid induced 14; NM_001145525.1) | TAL1 (T-cell acute lymphocytic leukemia 1; X51990.1) | SLC25A37 (solute carrier family 25 member 37; NM_001317812.1) |
| SCARB2 (scavenger receptor class B member 2; NM_001204255.1) | TPSAB1 (tryptase alpha/beta 1; NM_003294.3) | TNFRSF10C (TNF receptor superfamily member 10c; NM_003841.3) |
| SCG5 (secretogranin V; NM_001144757.2) | TPSB2 (tryptase beta 2; NM_024164.5) | VNN3 (vanin 3; NM_001291703.1) |
| SGMS1 (sphingomyelin synthase 1; NM_147156.3) | | |
| SULT1C2 (sulfotransferase family 1C member 2; NM_176825.2) | | |

*Each GenBank Accession Number is a representative or exemplary GenBank Accession Number for the listed gene and is herein incorporated by reference in its entirety for all purposes. Further, each listed representative or exemplary accession number should not be construed to limit the claims to the specific accession number.

TABLE 7

Individual Immunomarkers for use in the methods provided herein.

| Gene Name | Abbreviation | GenBank Accession No.* |
|---|---|---|
| Programmed Death Ligand 1 | PDL1 | NM_014143 |
| programmed death ligand 2 | PDL2 | AY254343 |
| programmed cell death 1 | PDCD1 | NM_005018 |
| cytotoxic T-lymphocyte associated protein 4 | CTLA4 | NM_005214 |

*Each GenBank Accession Number is a representative or exemplary GenBank Accession Number for the listed gene and is herein incorporated by reference in its entirety for all purposes. Further, each listed representative or exemplary accession number should not be construed to limit the claims to the specific accession number.

TABLE 8

Interferon (IFN) Genes for use in the methods provided herein.

| Gene Name | Abbreviation | GenBank Accession No.* |
|---|---|---|
| Chemokine (C-X-C Motif) Ligand 10 | CXCL10 | NM_001565 |
| C-X-C motif chemokine ligand 9 | CXCL9 | NM_002416 |
| Interferon alpha inducible protein 27 | IFI27 | NM_001130080 |
| Interferon induced protein with tetratricopeptide repeats 1 | IFIT1 | NM_001548 |
| interferon induced protein with tetratricopeptide repeats 2 | IFIT2 | NM_001547 |
| interferon induced protein with tetratricopeptide repeats 3 | IFIT3 | NM_001549 |
| MX dynamin like GTPase 1 | MX1 | NM_001144925 |
| MX dynamin like GTPase 2 | MX2 | XM_005260983 |
| 2'-5'-oligoadenylate synthetase 1 | OAS1 | NM_016816 |
| 2'-5'-oligoadenylate synthetase 2 | OAS2 | NM_016817 |
| signal transducer and activator of transcription 1 | STAT1 | NM_007315 |
| signal transducer and activator of transcription 2 | STAT2 | NM_005419 |

*Each GenBank Accession Number is a representative or exemplary GenBank Accession Number for the listed gene and is herein incorporated by reference in its entirety for all purposes. Further, each listed representative or exemplary accession number should not be construed to limit the claims to the specific accession number.

TABLE 9

MHC class II genes for use in the methods provided herein.

| Name | Abbreviation | GenBank Accession No.* |
|---|---|---|
| CD74 | Homo sapiens CD74 molecule (CD74) | NM_001025159 |
| CIITA | class II major histocompatibility complex transactivator | NM_001286402 |
| CTSH | cathepsin H | NM_004390 |
| HLA-DMA | Homo sapiens major histocompatibility complex, class II, DM alpha | NM_006120 |
| HLA-DPA1 | Homo sapiens major histocompatibility complex, class II, DP alpha 1 | NM_033554 |
| HLA-DPB1 | Human MHC class II lymphocyte antigen (HLA-DP) beta chain | M83664 |
| HLA-DQA1 | Homo sapiens major histocompatibility complex, class II, DQ alpha 1 | NM_002122 |
| HLA-DRB1 | Homo sapiens major histocompatibility complex, class II, DR beta 1 | NM_002124 |
| HLA-DRB5 | Homo sapiens major histocompatibility complex, class II, DR beta 5 | NM_002125 |
| HLA-DRB6 | Homo sapiens major histocompatibility complex, class II, DR beta 6 | NR_001298 |
| NCOA1 | Homo sapiens nuclear receptor coactivator 1 | NM_003743 |

*Each GenBank Accession Number is a representative or exemplary GenBank Accession Number for the listed gene and is herein incorporated by reference in its entirety for all purposes. Further, each listed representative or exemplary accession number should not be construed to limit the claims to the specific accession number.

In one embodiment, upon determining a patient's HNSCC cancer subtype using any of the methods and classifier biomarkers panels or subsets thereof as provided herein alone or in combination with determining expression of one or more immune cell markers as provided herein and/or expression of HPV genes, the patient is selected for treatment with or administered an immunotherapeutic agent. The immunotherapeutic agent can be a checkpoint inhibitor, monoclonal antibody, biological response modifiers, therapeutic vaccine or cellular immunotherapy.

In another embodiment, the immunotherapeutic agent is a checkpoint inhibitor. In some cases, a method for determining the likelihood of response to one or more checkpoint inhibitors is provided. In one embodiment, the checkpoint inhibitor is a PD-1/PD-LI checkpoint inhibitor. The PD-1/

PD-L1 checkpoint inhibitor can be nivolumab, pembrolizumab, atezolizumab, durvalumab, lambrolizumab, or avelumab. In one embodiment, the checkpoint inhibitor is a CTLA-4 checkpoint inhibitor. The CTLA-4 checkpoint inhibitor can be ipilimumab or tremelimumab. In one embodiment, the checkpoint inhibitor is a combination of checkpoint inhibitors such as, for example, a combination of one or more PD-1/PD-LI checkpoint inhibitors used in combination with one or more CTLA-4 checkpoint inhibitors.

In one embodiment, the immunotherapeutic agent is a monoclonal antibody. In some cases, a method for determining the likelihood of response to one or more monoclonal antibodies is provided. The monoclonal antibody can be directed against tumor cells or directed against tumor products. The monoclonal antibody can be panitumumab, matuzumab, necitumumab, trastuzumab, amatuximab, bevacizumab, ramucirumab, bavituximab, patritumab, rilotumumab, cetuximab, immu-132, or demcizumab.

In yet another embodiment, the immunotherapeutic agent is a therapeutic vaccine. In some cases, a method for determining the likelihood of response to one or more therapeutic vaccines is provided. The therapeutic vaccine can be a peptide or tumor cell vaccine. The vaccine can target MAGE-3 antigens, NY-ESO-1 antigens, p53 antigens, survivin antigens, or MUC1 antigens. The therapeutic cancer vaccine can be GVAX (GM-CSF gene-transfected tumor cell vaccine), belagenpumatucel-L (allogeneic tumor cell vaccine made with four irradiated NSCLC cell lines modified with TGF-beta2 antisense plasmid), MAGE-A3 vaccine (composed of MAGE-A3 protein and adjuvant AS15), (1)-BLP-25 anti-MUC-1 (targets MUC-1 expressed on tumor cells), CimaVax EGF (vaccine composed of human recombinant Epidermal Growth Factor (EGF) conjugated to a carrier protein), WT1 peptide vaccine (composed of four Wilms' tumor suppressor gene analogue peptides), CRS-207 (live-attenuated *Listeria monocytogenes* vector encoding human mesothelin), Bec2/BCG (induces anti-GD3 antibodies), GV1001 (targets the human telomerase reverse transcriptase), TG4010 (targets the MUC1 antigen), racotumomab (anti-idiotypic antibody which mimicks the NGcGM3 ganglioside that is expressed on multiple human cancers), tecemotide (liposomal BLP25; liposome-based vaccine made from tandem repeat region of MUC1) or DRibbles (a vaccine made from nine cancer antigens plus TLR adjuvants).

In one embodiment, the immunotherapeutic agent is a biological response modifier. In some cases, a method for determining the likelihood of response to one or more biological response modifiers is provided. The biological response modifier can trigger inflammation such as, for example, PF-3512676 (CpG 7909) (a toll-like receptor 9 agonist), CpG-ODN 2006 (downregulates Tregs), *Bacillus* Calmette-Guerin (BCG), *mycobacterium* vaccae (SRL172) (nonspecific immune stimulants now often tested as adjuvants). The biological response modifier can be cytokine therapy such as, for example, IL-2+ tumor necrosis factor alpha (TNF-alpha) or interferon alpha (induces T-cell proliferation), interferon gamma (induces tumor cell apoptosis), or Mda-7 (IL-24) (Mda-7/IL-24 induces tumor cell apoptosis and inhibits tumor angiogenesis). The biological response modifier can be a colony-stimulating factor such as, for example granulocyte colony-stimulating factor. The biological response modifier can be a multi-modal effector such as, for example, multi-target VEGFR: thalidomide and analogues such as lenalidomide and pomalidomide, cyclophosphamide, cyclosporine, denileukin diftitox, talactoferrin, trabecetedin or all-trans-retinmoic acid.

In one embodiment, the immunotherapy is cellular immunotherapy. In some cases, a method for determining the likelihood of response to one or more cellular therapeutic agents. The cellular immunotherapeutic agent can be dendritic cells (DCs) (ex vivo generated DC-vaccines loaded with tumor antigens), T-cells (ex vivo generated lymphokine-activated killer cells; cytokine-induce killer cells; activated T-cells; gamma delta T-cells), or natural killer cells.

In some cases, specific subtypes of HNSCC have different levels of immune activation (e.g., innate immunity and/or adaptive immunity) such that subtypes with elevated or detectable immune activation (e.g., innate immunity and/or adaptive immunity) are selected for treatment with one or more immunotherapeutic agents described herein. In some cases, specific subtypes of HNSCC have high or elevated levels of immune activation. In some cases, the MS subtype of AD has elevated levels of immune activation (e.g., innate immunity and/or adaptive immunity) as compared to other HNSCC subtypes. In some cases, the HPV positive, AT-like subtype of HNSCC has elevated levels of immune activation (e.g., innate immunity and/or adaptive immunity) as compared to other HNSCC subtypes. In one embodiment, HNSCC subtypes with low levels of or no immune activation (e.g., innate immunity and/or adaptive immunity) are not selected for treatment with one or more immunotherapeutic agents described herein.

Radiotherapy

In one embodiment, provided herein is a method for determining whether a HNSCC cancer patient is likely to respond to radiotherapy by determining the subtype of HNSCC of a sample obtained from the patient and, based on the HNSCC subtype, assessing whether the patient is likely to respond to radiotherapy. In another embodiment, provided herein is a method of selecting a patient suffering from HNSCC for radiotherapy by determining a HNSCC subtype of a sample from the patient and, based on the HNSCC subtype, selecting the patient for radiotherapy. The determination of the HNSCC subtype of the sample obtained from the patient can be performed using any method for subtyping HNSCC known in the art. The determination of the HNSCC subtype of the sample obtained from the patient can be performed using any method for subtyping HNSCC provided herein. In some embodiments, the method for HNSCC subtyping includes detecting expression levels of a classifier biomarker set alone or in combination with one or more biomarkers of HPV. The classifier biomarker set can be a set of biomarkers from a publically available database such as, for example, TCGA HNSCC RNASeq gene expression dataset(s) or any other dataset provided herein. In some embodiments, the detecting includes all of the classifier biomarkers of Table 1 or Table 3 or any other dataset provided herein at the nucleic acid level or protein level. In one embodiment, from about 1 to about 5, about 5 to about 10, from about 5 to about 15, from about 5 to about 20, from about 5 to about 25, from about 5 to about 30, from about 5 to about 35, from about 5 to about 40, from about 5 to about 45, from about 5 to about 50, from about 5 to about 55, from about 5 to about 60, from about 5 to about 65, from about 5 to about 70, from about 5 to about 75, or from about 5 to about 80 of the biomarkers in any of the HNSCC gene expression datasets provided herein, including, for example, Table 1 or Table 3 for an HNSCC sample are detected in a method to determine the HNSCC subtype as provided herein. In another embodiment, each of the biomarkers from any one of the HNSCC gene expression datasets provided herein, including, for example, Table 1 or Table 3 for an HNSCC sample are detected in a method to determine the HNSCC subtype as provided herein. Further to the above embodiments, the HPV status can be determined by measuring one or more biomarkers of HPV as described herein.

In some embodiments, the radiotherapy can include but are not limited to proton therapy and external-beam radiation therapy. In some embodiments, the radiotherapy can include any types or forms of treatment that is suitable for HNSCC patients. In some embodiments, the surgery can include laser technology, excision, lymph node dissection or neck dissection, and reconstructive surgery.

In some embodiments, an HNSCC can have or display resistance to radiotherapy. Radiotherapy resistance in any HNSCC subtype can be determined by measuring or detecting the expression levels of one or more genes known in the art and/or provided herein associated with or related to the presence of radiotherapy resistance. Genes associated with radiotherapy resistance can include NFE2L2, KEAP1 and CUL3. In some embodiments, radiotherapy resistance can be associated with the alterations of KEAP1 (Kelch-like ECH-associated protein 1)/NRF2 (nuclear factor E2-related factor 2) pathway. Association of a particular gene to radiotherapy resistance can be determined by examining expression of said gene in one or more patients known to be radiotherapy non-responders and comparing expression of said gene in one or more patients known to be radiotherapy responders. In one embodiment, the HNSCC subtype that has radiotherapy resistance can be a CL subtype. In some embodiments, the HNSCC subtype that has radiotherapy resistance can be a BA subtype. In some embodiments, the HNSCC subtype that has radiotherapy resistance can be a MS subtype. In some embodiments, the HNSCC subtype that has radiotherapy resistance can be an AT subtype. In some embodiments, the HNSCC subtype that has radiotherapy resistance can be any HNSCC subtypes. In one embodiment, the HNSCC subtype is a CL subtype. The HNSCC patient can be HPV-negative or positive. In some embodiments, the methods for clinical applications as described herein can determine radiotherapy resistance for surgically resectable HPV-negative or HPV-positive HNSCC cases.

Surgical Intervention

In one embodiment, provided herein is a method for determining whether a HNSCC cancer patient is likely to respond to surgical intervention by determining the subtype of HNSCC of a sample obtained from the patient and, based on the HNSCC subtype, assessing whether the patient is likely to respond to surgery. In another embodiment, provided herein is a method of selecting a patient suffering from HNSCC for surgery by determining a HNSCC subtype of a sample from the patient and, based on the HNSCC subtype, selecting the patient for surgery. The determination of the HNSCC subtype of the sample obtained from the patient can be performed using any method for subtyping HNSCC known in the art. The determination of the HNSCC subtype of the sample obtained from the patient can be performed using any method for subtyping HNSCC provided herein. In some embodiments, the method for HNSCC subtyping includes detecting expression levels of a classifier biomarker set alone or in combination with one or more biomarkers of HPV. The classifier biomarker set can be a set of biomarkers from a publically available database such as, for example, TCGA HNSCC RNASeq gene expression dataset(s) or any other dataset provided herein. In some embodiments, the detecting includes all of the classifier biomarkers of Table 1 or Table 3 or any other dataset provided herein at the nucleic acid level or protein level. In one embodiment, from about 1 to about 5, about 5 to about 10, from about 5 to about 15, from about 5 to about 20, from about 5 to about 25, from about 5 to about 30, from about 5 to about 35, from about 5 to about 40, from about 5 to about 45, from about 5 to about 50, from about 5 to about 55, from about 5 to about 60, from about 5 to about 65, from about 5 to about 70, from about 5 to about 75, or from about 5 to about 80 of the biomarkers in any of the HNSCC gene expression datasets provided herein, including, for example, Table 1 or Table 3 for an HNSCC sample are detected in a method to determine the HNSCC subtype as provided herein. In another embodiment, each of the biomarkers from any one of the HNSCC gene expression datasets provided herein, including, for example, Table 1 or Table 3 for an HNSCC sample are detected in a method to determine the HNSCC subtype as provided herein. Further to the above embodiments, the HPV status can be determined by measuring one or more biomarkers of HPV as described herein.

In some embodiments, surgery approaches for use herein can include but are not limited to minimally invasive or endoscopic head and neck surgery (eHNS), Transoral Robotic Surgery (TORS), Transoral Laser Microsurgery (TLM), Endoscopic Thyroid and Neck Surgery, Robotic Thyroidectomy, Minimally Invasive Video-Assisted Thyroidectomy (MIVAT), and Endoscopic Skull Base Tumor Surgery. In some embodiments, the surgery can include any types of surgical treatment that is suitable for HNSCC patients. In one embodiment, the suitable treatment is surgery.

Prediction of Overall Survival Rate and Metastasis for HNSCC Patients

The present disclosure provides methods for predicting overall survival rate for a HNSCC patient. In some embodiments, the prediction of overall survival rate can involve obtaining a head and neck tissue sample for a HNSCC patient. In some embodiments, the HNSCC patients can have various stages of cancers. In some embodiments, the overall survival rate can be determined by detecting the expression level of at least one subtype classifier of a publically available head and neck cancer database or dataset. In some embodiments, an overall survival rate can be determined by detecting the expression level (e.g., protein and/or nucleic acid) of any subtype classifiers that are relevant to HNSCC. In one embodiment, the subtype classifiers can be all or a subset of classifiers from Table 1 or Table 3. The method can further entail determining the HPV status of the HNSCC patient. HPV status can be determined as provided herein. The HNSCC patient or subject can be HPV-negative or HPV-positive.

In some embodiments, the present disclosure further provide methods of predicting overall survival in HNSCC from specific areas of the head and neck such as, for example, the oral cavity (i.e., oral cavity squamous cell carcinoma (OCSCC)) or larynx (i.e., larynx squamous cell carcinoma (LSCC)). In some embodiments, the prediction includes detecting an expression level of at least one gene from an HNSCC dataset (e.g., Table 1 or Table 3) in a head and neck tissue sample (e.g., sample from oral cavity or larynx) obtained from a patient. In some embodiments, the detection of the expression level of a subtype classifier from an HNSCC dataset (e.g., Table 1 or Table 3) using the methods provided herein specifically identifies a BA, MS, AT or CL OCSCC or LSCC subtype. In some embodiments, the identification of the OCSCC subtype is indicative of the overall survival in the patient. A mesenchymal subtype of OCSCC as ascertained by measuring one or more subtype classifiers in a sample obtained from an OCSCC patient as provided herein can indicate a poor overall survival of an OCSCC patient as compared to patients with other subtypes of OCSCC. In some embodiments, the identification of the LSCC subtype is indicative of the overall survival in the patient. A classical subtype of LSCC as ascertained by measuring one or more subtype classifiers in a sample obtained from a LSCC patient as provided herein can indicate a poor overall survival of a LSCC patient as compared to patients with other subtypes of LSCC.

The present disclosure provides methods for predicting nodal metastasis for a HNSCC patient. In some embodiments, the prediction of nodal metastasis can involve obtaining a head and neck tissue sample for a HNSCC patient. In some embodiments, the HNSCC patients can have various stages of cancers. In some embodiments, the nodal metastasis can be determined by detecting the expression level of at least one subtype classifier from a head and neck gene set. The head and neck gene set can be a publically available head and neck database or a head and neck gene set provided herein (e.g. Table 1 or Table 3) or a combination thereof. The publically available head and neck gene set can be the TCGA HNSCC gene set. In one embodiment, nodal metastasis of HNSCC can be determined by detecting the expression level of all the subtype classifiers or subsets thereof of the classifiers found in Table 1 or Table 3. The HNSCC subject can be HPV-negative or HPV-positive.

In some embodiments, the MS subtype of HNSCC can be more likely to be associated with nodal metastasis compared with other subtypes such as CL, BA or AT. In some embodiments, the OCSCC MS subtype can be most likely associated with positive lymph node metastasis compared with other OCSCC subtypes such as CL, BA or AT. In some embodiments, the OCSCC MS subtype can be at least about 0.1 times, at least about 0.2 times, at least about 0.3 times, at least about 0.4 times, at least about 0.5 times, at least about 0.6 times, at least about 0.7 times, at least about 0.8 times, at least about 0.9 times, at least about 1 time, at least about 1.2 times, at least about 1.5 times, at least about 1.7 times, at least about 2.0 times, at least about 2.2 times, at least about 2.5 times, at least about 2.7 times, at least about 3.0 times, at least about 3.2 times, at least about 3.5 times, at least about 3.7 times, at least about 4.0 times, at least about 4.2 times, at least about 4.5 times, at least about 4.7 times, at least about 5.0 times, inclusive of all ranges and subranges therebetween, more likely to have occult nodal metastasis compared to other OCSCC subtypes such as CL, BA or AT. In one embodiment, the OCSCC MS subtype can be at least about 3 times more likely to have occult nodal metastasis compared to the BA subtype.

Detection Methods

In one embodiment, the methods and compositions provided herein allow for the detection of at least one nucleic acid in a HNSCC sample obtained from a subject. The at least one nucleic acid can be a classifier biomarker and/or HPV gene(s) provided herein. In one embodiment, the at least one nucleic acid detected using the methods and compositions provided herein are selected from Table 1 or Table 3 alone or in combination with one or more HPV genes. In one embodiment, the methods of detecting the nucleic acid(s) (e.g., classifier biomarkers) in the HNSCC sample obtained from the subject comprises, consists essentially of, or consists of measuring the expression level of at least one or a plurality of biomarkers using any of the methods provided herein. The biomarkers can be selected from Table 1 or Table 3. In some cases, the plurality of biomarker nucleic acids comprises, consists essentially of or consists of at least two biomarker nucleic acids, at least 18 biomarker nucleic acids, at least 36 biomarker nucleic acids, at least 54 biomarker nucleic acids, at least 72 biomarker nucleic acids, at least 90 biomarker nucleic acids, at least 108 biomarker nucleic acids, at least 126 biomarker nucleic acids, or all 144 biomarkers nucleic acids of Table 1. In some cases, the plurality of biomarker nucleic acids comprises, consists essentially of or consists of at least two biomarker nucleic acids, at least 10 biomarker nucleic acids, at least 20 biomarker nucleic acids, at least 30 biomarker nucleic acids, at least 40 biomarker nucleic acids, at least 50 biomarker nucleic acids, at least 60 biomarker nucleic acids, at least 70 biomarker nucleic acids, or all 80 biomarkers nucleic acids of Table 1. The detection can be at the nucleic acid level. The detection can be by using any amplification, hybridization and/or sequencing assay disclosed herein.

In another embodiment, the methods and compositions provided herein allow for the detection of at least one nucleic acid or a plurality of nucleic acids in a head and neck cancer sample (e.g. HNSCC sample) obtained from a subject such that the at least one nucleic acid is or the plurality of nucleic acids are selected from the biomarkers listed in Table 1 or Table 3 alone or in combination with one or more HPV genes and the detection of at least one biomarker from a set of biomarkers whose presence, absence and/or level of expression is indicative of immune activation. The set of biomarkers for indicating immune activation can be gene expression signatures of and/or Adaptive Immune Cells (AIC) (e.g., Table 6A) and/or Innate Immune Cells (IIC) (e.g., Table 6B), individual immune biomarkers (e.g., Table 7), interferon genes (e.g., Table 8), major histocompatibility complex, class II (MHC II) genes (e.g., Table 9) or a combination thereof. The gene expression signatures of both IIC and AIC can be any gene signatures known in the art such as, for example, the gene signature listed in Bindea et al. (Immunity 2013; 39(4); 782-795). The detection can be at the nucleic acid level. The detection can be by using any amplification, hybridization and/or sequencing assay disclosed herein.

Kits

Kits for practicing the methods of the invention can be further provided. By "kit" can encompass any manufacture (e.g., a package or a container) comprising at least one reagent, e.g., an antibody, a nucleic acid probe or primer, etc., for specifically detecting the expression of a biomarker of the invention. The kit may be promoted, distributed, or sold as a unit for performing the methods of the present invention. Additionally, the kits may contain a package insert describing the kit and methods for its use.

In one embodiment, kits for practicing the methods of the invention are provided. Such kits are compatible with both manual and automated immunocytochemistry techniques (e.g., cell staining). These kits comprise at least one antibody directed to a biomarker of interest, chemicals for the detection of antibody binding to the biomarker, a counterstain, and, optionally, a bluing agent to facilitate identification of positive staining cells. Any chemicals that detect antigen-antibody binding may be used in the practice of the invention. The kits may comprise at least 2, at least 3, at least 4, at least 5, at least 6, at least 7, at least 8, at least 9, at least 10, or more antibodies for use in the methods of the invention.

EXAMPLES

The present invention is further illustrated by reference to the following Examples. However, it should be noted that

Example 1—Development and Validation of the Head and Neck Squamous Cell Carcinoma (HNSCC) Subtyping Signature Background Head and Neck Squamous Cell Carcinoma (HNSCC) is comprised of cancers arising from the oral cavity, oropharynx, nasopharynx, hypopharynx, and larynx are responsible for approximately 3% of all malignancies (NCI HNSCC www.cancer.gov/types/head-and-neck/hp accessed 6-7-17). The most significant predisposing factors include heavy smoking and/or alcohol use, and more recently an increasing proportion of HNSCC tumors caused by Human Papilloma Virus (HPV) Infection. In the United States, it is projected that there are approximately 60,000 new cases and 12,000 deaths in 2015 [1]. HNSCC is traditionally managed with surgery, radiation therapy, and/or chemotherapy; early stage tumors are often managed with a single treatment modality while advanced stage tumors require multimodality therapy. Risk stratification and treatment decisions vary by anatomic site, stage at presentation, histologic characteristics of the tumor, and patient factors.

Recent advances in cancer genomics have led to an increased understanding of mutational and gene expression profiles in HNSCC. HNSCC subtypes, as defined by underlying genomic features, have shown varied cell of origin, tumor drivers, proliferation, immune responses, and prognosis [2,3,4]. While traditionally associated with tobacco and alcohol use, an increased number of incident oropharyngeal cancers are caused by human papillomavirus (HPV), thus there has been a growing interest in studies of HPV associated HNSCC tumors. With the exception of the use of P16 immunohistochemistry as a marker of HPV infection in oropharyngeal tumors, the molecular characteristics of HNSCC have largely not been incorporated into risk stratification, drug response stratification, nor clinical management decisions (chemotherapy, etc).

Objective

This example was initiated to address the need for an efficient method for improved tumor classification that could inform prognosis, drug response and patient management based on underlying genomic and biologic tumor characteristics. Using multiple available public datasets, including the TCGA [2] and Von Walter et al. (GSE 39366) [3] Keck et al. (GSE 40774) [4] and Wichman et al. (GSE 65858) [5] and the accompanying HPV gene expression results, where available, an HNSCC subtyping method and algorithm was developed. The diagnostic method developed in this example includes evaluation of gene expression subtypes followed by HPV gene expression and application of an algorithm for categorization of HNSCC tumors into one of 5 subtypes (Atypical (AT), Mesenchymal (MS), Classical (CL), Basal (BA), and HPV "Atypical-like").

Methods

Figure 16:
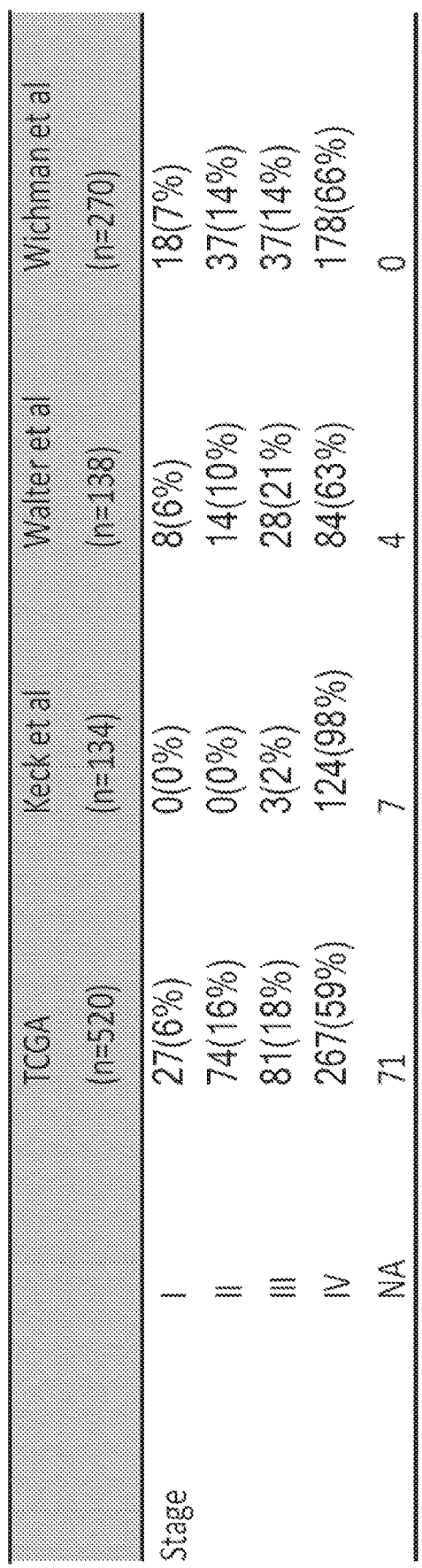
FIG. 16 provides stage information for the TCGA dataset, and the other datasets used to develop and validate the GeneCentric HNSCC subtyping.

The TCGA HNSCC gene expression data [2] generated from whole-transcriptome RNAseq was examined using the 840-gene classifier previously developed by Von Walter et al. [3] to differentiate the BA, CL, MS and AT HNSCC subtypes. To develop a reduced and clinically applicable gene signature for evaluation of HNSCC tumors, a 5-fold cross-validation (CV) on the entire TCGA HNSCC dataset (n=520) was conducted to find the number of genes that would be required to provide differentiation of the subtypes with sufficient agreement with the previously developed gold standard (i.e., aforementioned 840-gene classifier) as shown in FIG. 1. Prototype samples were then chosen based on the gold standard silhouette (n=416 samples selected). A minimal gene set that optimally classified the Basal (BA), Classical (CL), Mesenchymal (MS), and Atypical (AT) subtypes was identified using a modification of the software packages ClaNC [6]. The Clanc t-statistics were calculated for all 840 gold standard subtyping genes [2.3] using the prototype samples and 144 genes were selected based on the ranks of the strongest t-statistics using a 50% high and 50% low modification (i.e., select an equal number of negatively and positively correlated genes for each HNSCC subtype). A nearest centroid classifier was fit using the 144 genes and the prototypes only followed by an evaluation of the full TCGA dataset (n=520). Validation of the reduced gene signature was compared to the gold standard 840 gene signature in TCGA datasets and in several other publicly available datasets including Keck, Von Walter, and Wichman, references [3,4,5]. FIG. 11 and FIG. 16 depict the patient characteristics for the datasets used to develop (i.e., TCGA HNSCC dataset) and validate (i.e., TCGA, Keck, von Walter and Wichman) the HNSCC 144 subtyping gene signature. Agreement with the gold standard was measured on the full TCGA dataset as well as the remaining datasets. The Keck data set was markedly enriched for HPV+ samples and HNSCC subtyping took this into account by adjusting gene centering values to reflect the HPV distribution in the training set using methods similar to Tibshirani et al. [7]. In addition, signatures that used subsets of the 144 genes were evaluated and compared to the gold standard and 144 subtyping gene signature.

Samples were also evaluated for ongoing HPV replication by evaluation of HPV gene expression. Ongoing HPV replication was assessed by RNAseq evaluation of HPV aligned sequences in HPV types 16, 18, 33, and 35 at levels>1000 counts. HPV reference sequence data was based on the PaVe website: pave.niaid.nih.gov/. Read Counts of >1000 for HPV RNAseq (TCGA) or HPV E6 gene expression [4] were used as the criterion for ongoing HPV replication and an HPV positive tumor designation.

Most HPV positive HNSCC tumors subtype as "Atypical", however not all HPV positive tumors are "atypical". For those tumors with >1000 HPV read counts and a gene expression subtype other than "atypical", the correlation to the nearest centroid, to the Atypical centroid, and the silhouette score were evaluated to assist in categorizing that tumor as HPV "atypical-like" group or as one of the other non-HPV gene expression subtypes (Basal, Classical, or Mesenchymal). In addition to atypical subtype, HPV+ samples, a high correlation to the atypical subtype with a low silhouette score was used to assess the need for inclusion of additional HPV positive samples into the HPV positive "atypical-like" subtype. The survival differences between HPV "atypical-like" as compared to other non-atypical HPV positive subtypes was evaluated.

Results

Development of the 144 Gene Signature

The 144 gene signature gene list developed in this study is shown in Table 1, while the 80 gene signature gene list can be found in Table 2. Agreement of subtype calls using the 144 gene signature with the published 840 gold standard gene signature subtype call in several different test datasets is shown in FIG. 12. The newly developed 144 gene signature demonstrated agreement of 0.87 in the TCGA dataset and a range of 0.83-0.86 in the other 3 test datasets. FIG. 11 and FIG. 16 provide a summary of the test datasets.

The smaller gene signature (80 genes) showed marginally lower concordance to the gold standard (84% vs. 87%) than the 144 gene signature (see FIGS. 14 and 15).

Evaluation of HPV Status and Assignment to the HPV "Atypical-Like" Subtype

The majority but not all of the HPV positive samples (as evaluated by gene expression) belonged to the atypical gene expression subtype (see FIG. 13). As seen in FIG. 13, this observation was true using either the gold standard or 144 gene signature as the subtyping tool. Some tumors displayed biologic characteristics that were more like other subtypes despite the presence of HPV gene expression. These tumors appeared to be more similar to smoking related tumors and were reflective of a different biology and possibly different prognosis. For this reason, a subtyping algorithm was developed that incorporated both the HPV status and the gene expression subtype in identifying 5 relevant subtypes in HNSCC (i.e., Atypical (AT), Mesenchymal (MS), Classical (CL), Basal (BA), and HPV "Atypical-like").

As shown in the survival curves in comparing HPV atypical vs. HPV positive non-Atypical tumors in TCGA using the 144 gene gold standard (FIG. 2A), the HPV positive samples that did not belong to the atypical gene expression subtype or "atypical-like" subtype demonstrated a worse survival and may be more similar to smoking induced non-HPV HNSCC tumors. This observation was corroborated by the survival curves comparing HPV atypical vs. HPV positive non-Atypical tumors in Keck [4] with and without adjustment by correlation and silhouette score using the 144 gene gold standard (FIG. 3) and survival curves comparing HPV positive atypical to HPV positive non-Atypical tumors in the TCGA dataset with and without adjustment by correlation and silhouette score using the 840 gene gold standard (FIGS. 4A and 4B). It was noted that in FIGS. 4A and 4B, a few non-atypical samples having both high correlation with the atypical centroid and with low silhouettes may reflect underlying biology more similar to the HPV atypical-like subtype. When these samples were included in the HPV+ atypical-like subtype, the survival differences were enhanced (see FIG. 4C). Correlation with the atypical centroid and silhouette scores for the non-atypical HPV positive tumors was included to assist in determining inclusion of an HPV positive tumor in the "HPV atypical-like" subtype (see FIGS. 2B, 3 and 4B).

Conclusion

Development and validation of a 144 and 80 gene signature for HNSCC subtyping was described. The resulting 144 and 80 gene signatures maintain low misclassification rates when applied to several independent test sets. Further, the 144 gene signature in combination with evaluation of HPV status, as defined by HPV gene expression, was developed to classify tumors of HNSCC into 5 subtypes, Basal, Classical, Mesenchymal, Atypical, and HPV Atypical-like. The 5 subtypes showed differences in HPV status, underlying biology, prognosis, immune response, and likely response to a variety of therapeutics. Important differences in prognosis and survival of HPV positive tumors that differ in their gene expression subtype (those that are atypical-like vs HPV tumors that are not atypical-like but rather more closely resemble other HNSCC tumor subtypes) were demonstrated. The different HPV tumors demonstrate differences in prognosis that may be meaningful to therapeutic management.

Incorporation by Reference

The following references are incorporated by reference in their entireties for all purposes.

1.) Siegel R L, Miller K D, Jemal A. Cancer Statistics, 2015. CA Cancer J Clin. 2015; 65: 5-29. doi:10.3322/caac.21254
2.) Lawrence M S, Sougnez C, Lichtenstein L, Cibulskis K, Lander E, Gabriel S B, et al. Comprehensive genomic characterization of head and neck squamous cell carcinomas. Nature. 2015; 517: 576-582. doi:10.1038/nature14129
3.) Von Walter, Yin X, Wilkerson M D, Cabanski C R, Zhao N, Du Y, Ang M K, Hayward M C, Salazar A H, Hoadley K A, Fritchie K, Sailey C J, Weissler M C, Shockley W W, Zanation A M, Hackman T, Thorne L B, Funkhouser W D, Muldrew K L, Olshan A F, Randell S H, Wright F A, Shores C G, Hayes D N. (2013). Molecular Subtypes in Head and Neck Cancer Exhibit Distinct Patterns of Chromosomal Gain and Loss of Canonical Cancer Genes. PLoS One, 8(2):e56823. PMCID: 3579892.
4.) Keck M K, Zuo Z, Khattri a., Stricker T P, Brown C D, Imanguli M, et al. Integrative Analysis of Head and Neck Cancer Identifies Two Biologically Distinct HPV and Three Non-HPV Subtypes. Clin Cancer Res. 2014; 21: 870-881. doi:10.1158/1078-0432.CCR-14-2481
5.) Wichman G, Rosolowski M, Krohn K, et al. The role of HPV RNA transcription, immune response-related gene expression and disruptive TP53 mutations in diagnostic and prognostic profiling of head and neck cancer. Intl Jrnl Cancer 2015; 137: 2846-2857.
6.) Dabney A R. ClaNC: Point-and-click software for classifying microarrays to nearest centroids. Bioinformatics. 2006; 22: 122-123. doi:10.1093/bioinformatics/bti756
7.) Tibshirani R, Hastie T, Narasimhan B, Chu G. Diagnosis of multiple cancer types by shrunken centroids of gene expression. Proc Natl Acad Sci USA. 2002; 99: 6567-72. doi:10.1073/pnas.082099299
8.) Bindea G, Mlecnik B, Tosolini M, et al. Spatiotemporal dynamics of intratumoral immune cells reveal the immune landscape in human cancer. Immunity 2013; 39(4):782-95.

Example 2—Immune Cell Activation Differences Among HNSCC Intrinsic Subtypes as Determined Using HNSCC Subtyping Gene Signature from Example 1

Methods

Using previously published Bindea et al. (8) immune cell gene signatures (24 in total) and the TCGA HNSCC gene expression dataset (HNSCC n=520), immune cell expression and immunomarkers were examined in relation to the 5 HNSCC subtypes as defined using the 144 gene signature from Example 1. Gene expression signatures of both Innate Immune Cells (IIC) and Adaptive Immune Cells (AIC) as well as single gene immune biomarkers (CTLA4, PDCD1, and CD274 (PD-L1), PDCDLG2 (PD-L2)) and IFN were examined in all 5 HNSCC subtypes. Immune cell signature associations with tumor subtype and with CD274 expression were evaluated using linear regression. Survival immune cell signature associations were evaluated with stratified cox proportional hazard models allowing for different baseline hazards in each dataset.

Results

Heatmap analysis (FIG. 5) and hierarchical clustering (FIG. 7) of immune cell gene signatures provided separation of intrinsic subtypes of HNSCC. Further, immune cell signature gene expression patterns were consistent across multiple HNSCC (see FIG. 9) datasets. Strength of association of CD274 (PD-L1) expression and individual immune markers versus that for subtype (using the 144 gene signature) was conducted. As shown in FIG. 8, for HNSCC subtypes, association strengths (adjusted R squared from linear model) were mixed showing CD274 association greater for some cells (Treg, Tgd and Th1 cells), while HNSCC subtype association greater for others (B cells, T cells, T helper cells, cytotoxic cells, CD8 T cells, TFH, Th2, Tem, Th17, and Tcm).

Figure 10:
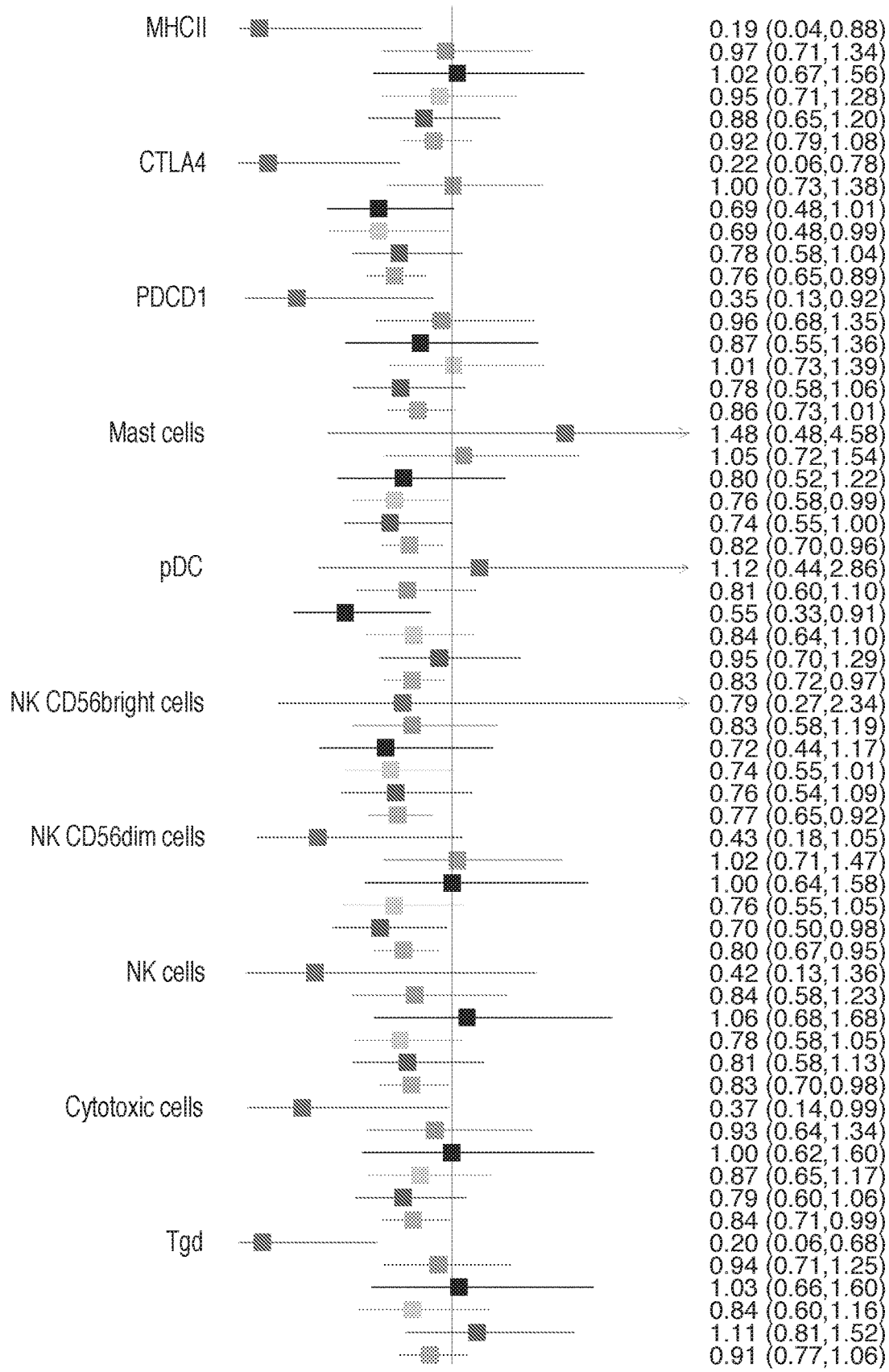
FIG. 10 illustrates TCGA immune marker-survival hazard ratios and nominal 95% confidence intervals, within subtype (adjusting for stage using coxph) and overall (adjusting for stage and subtype). Immune markers with at least one association p<0.05 are shown. 144-gene subtyper described in Example 1 was used.

Using cox proportional hazard models, subtype specific hazard ratios for one unit of increased expression were calculated. Subtype specific HR's were adjusted for pathologic stage and confidence intervals were calculated. The HR and CI for cell signatures or genes showing significant survival associations for one or more of the subtypes are shown in FIG. 10.

Figure 6:
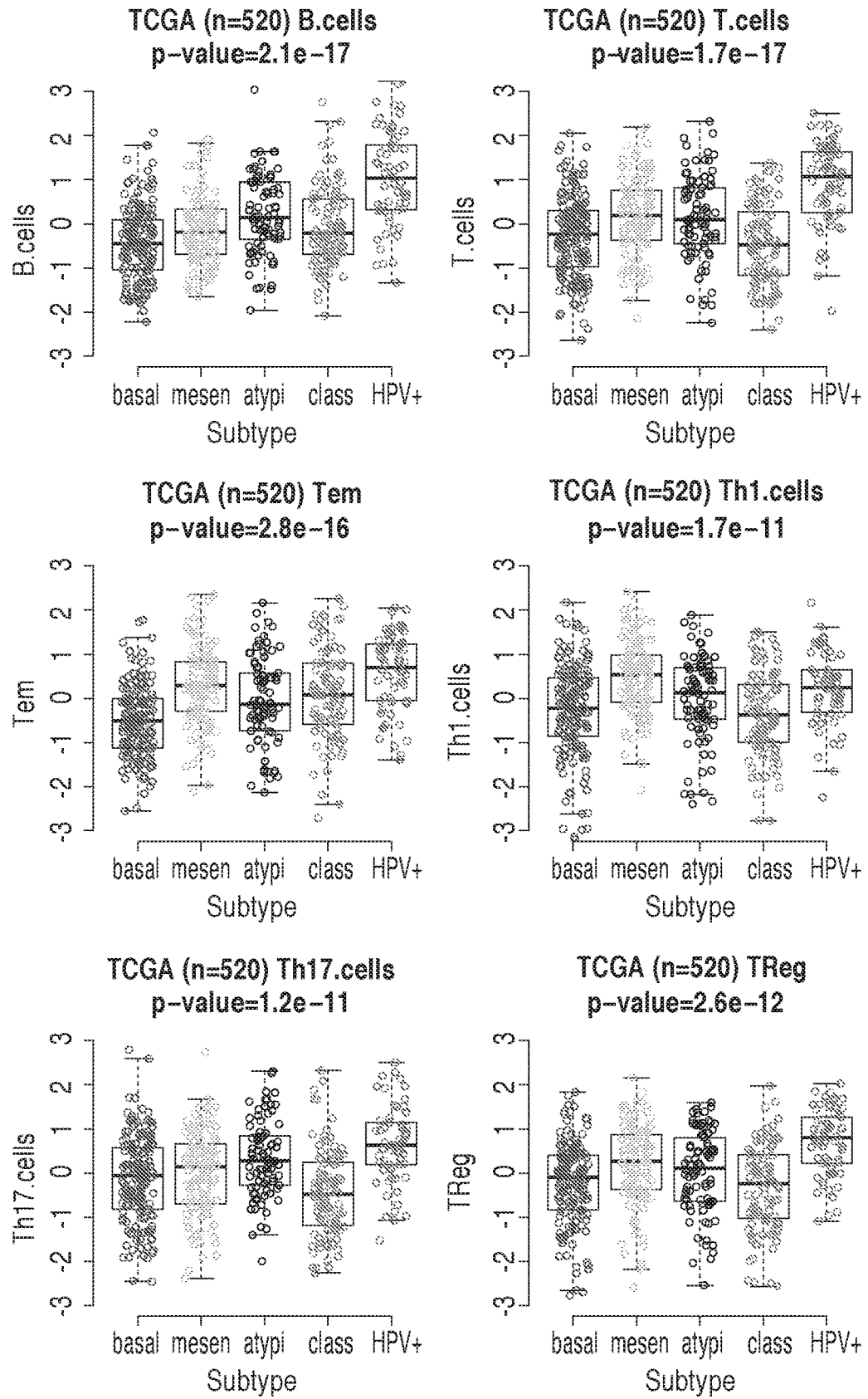
FIG. 6 illustrates boxplots of immune cells and immune markers across defined HNSCC subtypes (144 gene signature plus HPV gene expression) in the TCGA dataset. Mutation burden is also included at the end of the immune box plots.
Figure 7:
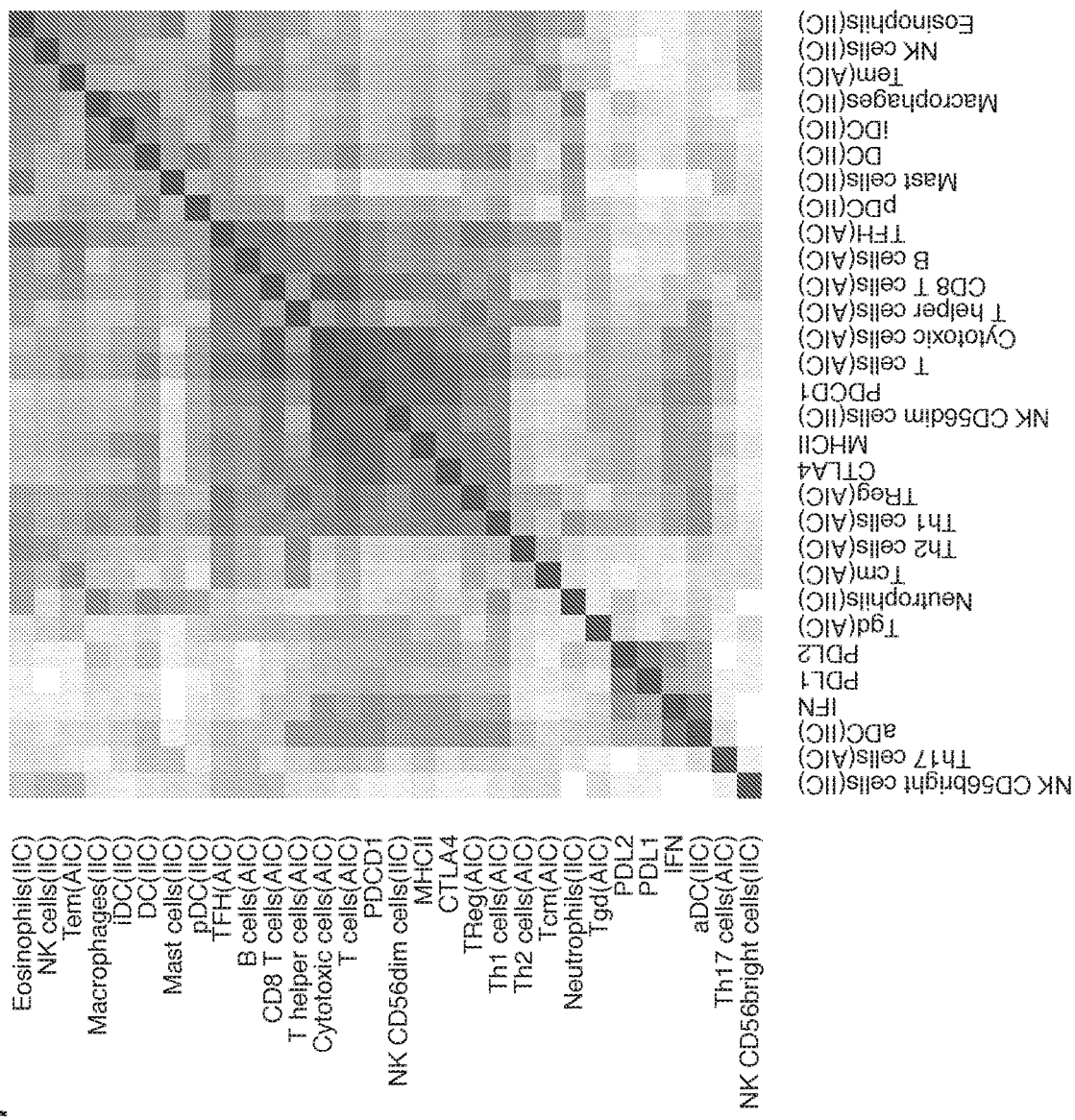
FIG. 7 illustrates a pairwise correlation matrix of immune cells and immune markers examined in the TCGA dataset
Figure 8:
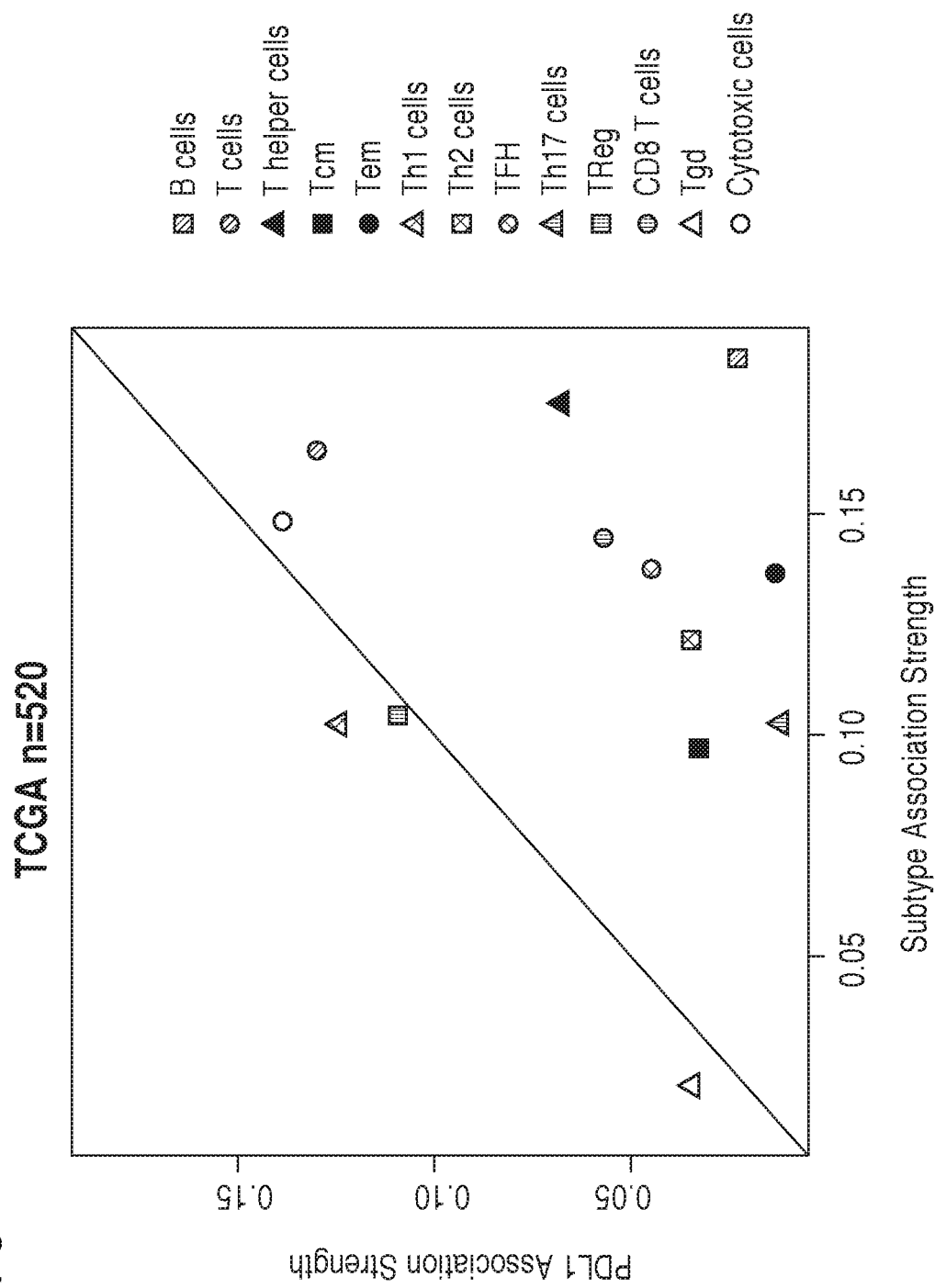
FIG. 8 illustrates association strength (adjusted R-squared from linear model) between PDL1 (low/high) and individual immune markers versus subtype (using the 144 gene signature with HPV group) and immune markers. PDL1 predictive strength of Tcell expression across the 5 subtypes.
Figure 9:
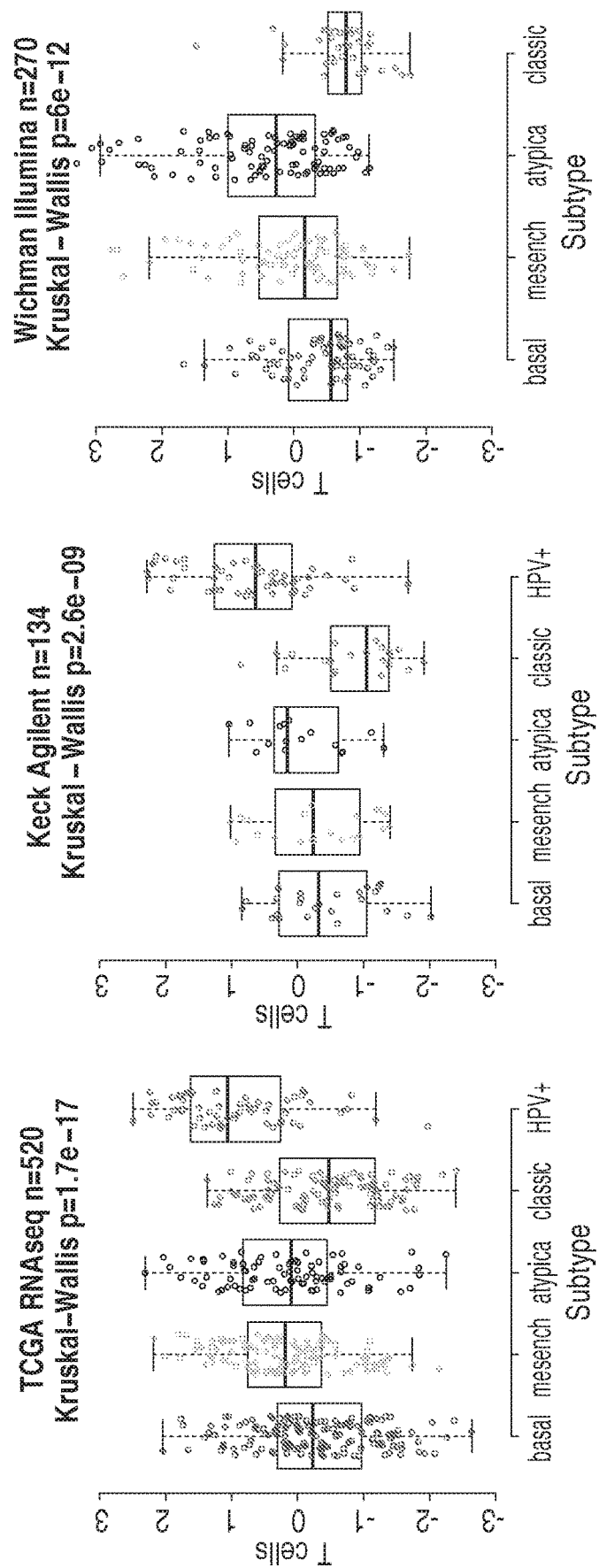
FIG. 9 illustrates Tcell expression pattern in various datasets using the 144 gene signature. Evaluations included the fifth subtype, HPV Atypical-like in datasets where gene expression of HPV was available.

In summary, immune cell expression was significantly different across the subtypes and was often higher in HPV positive tumors and in the Mesenchymal subtype tumors (see FIGS. 5, 6 and 7). Classical and Basal subtypes demonstrated lower immune expression, but were differentiated by the presence of elevated CD274 (PD-L1) and PDCD1LG2 (PD-L2) expression in the basal subtype (FIG. 6). Subtype and HPV status was a better predictor than by CD274 (PD-L1) expression for AIC expression (FIG. 8). Improved survival was associated with increased expression of T memory, T follicular helper, and NK CD56bright cells in the mesenchymal subtype (p<0.05), whereas Th2 cells, CD274 (PD-L1) and gene PDCD1LG2 (PD-L2) were associated with lower survival (p<0.05) (FIG. 6). A lower mutation burden was observed in the HPV "Atypical-like" tumors and improved survival was associated with increased expression of Tgamma delta cells and PDCD1 (PD-1) expression (p=0.01) (see FIG. 6).

Conclusion

Intrinsic biologic subtypes of HNSCC as defined by gene expression and by HPV gene expression reveal key differences in immune cell expression, which were not always correlated with CD274(PD-L1) expression. Accordingly, using the 144 gene signature (or the reduced 80 gene signature) in combination with HPV gene expression, immune cell/marker differences in HNSCC tumors that may inform immunotherapy treatments including checkpoint inhibitors as well as other therapeutic targets was demonstrated.

Incorporation by Reference

The following references are incorporated by reference in their entireties for all purposes.

1.) Siegel R L, Miller K D, Jemal A. Cancer Statistics, 2015. C A Cancer J Clin. 2015; 65: 5-29. doi:10.3322/caac.21254
2.) Lawrence M S, Sougnez C, Lichtenstein L, Cibulskis K, Lander E, Gabriel S B, et al. Comprehensive genomic characterization of head and neck squamous cell carcinomas. Nature. 2015; 517: 576-582. doi:10.1038/nature14129
3.) Von Walter, Yin X, Wilkerson M D, Cabanski C R, Zhao N, Du Y, Ang M K, Hayward M C, Salazar A H, Hoadley K A, Fritchie K, Sailey C J, Weissler M C, Shockley W W, Zanation A M, Hackman T, Thorne L B, Funkhouser W D, Muldrew K L, Olshan A F, Randell S H, Wright F A, Shores C G, Hayes D N. (2013). Molecular Subtypes in Head and Neck Cancer Exhibit Distinct Patterns of Chromosomal Gain and Loss of Canonical Cancer Genes. PLoS One, 8(2):e56823. PMCID: 3579892.
4.) Keck M K, Zuo Z, Khattri a., Stricker T P, Brown C D, Imanguli M, et al. Integrative Analysis of Head and Neck Cancer Identifies Two Biologically Distinct HPV and Three Non-HPV Subtypes. Clin Cancer Res. 2014; 21: 870-881. doi:10.1158/1078-0432.CCR-14-2481
5.) Wichman G, Rosolowski M, Krohn K, et al. The role of HPV RNA transcription, immune response-related gene expression and disruptive TP53 mutations in diagnostic and prognostic profiling of head and neck cancer. Intl Jrnl Cancer 2015; 137: 2846-2857.
6.) Dabney A R. ClaNC: Point-and-click software for classifying microarrays to nearest centroids. Bioinformatics. 2006; 22: 122-123. doi:10.1093/bioinformatics/bti756
7.) Tibshirani R, Hastie T, Narasimhan B, Chu G. Diagnosis of multiple cancer types by shrunken centroids of gene expression. Proc Natl Acad Sci USA. 2002; 99: 6567-72. doi:10.1073/pnas.082099299
8.) Bindea G, Mlecnik B, Tosolini M, et al. Spatiotemporal dynamics of intratumoral immune cells reveal the immune landscape in human cancer. Immunity 2013; 39(4):782-95.

Numbered Embodiments of the Disclosure

Other subject matter contemplated by the present disclosure is set out in the following numbered embodiments:

1. A method for determining a head and neck squamous cell carcinoma (HNSCC) subtype of a head and neck tissue sample obtained from a patient, the method comprising detecting an expression level of at least one classifier biomarker of Table 1 or Table 3, wherein the detection of the expression level of the classifier biomarker specifically identifies a basal (BA), mesenchymal (MS), atypical (AT) or classical (CL) HNSCC subtype.

2. The method of embodiment 1, wherein the method further comprises comparing the detected levels of expression of the at least one classifier biomarkers of Table 1 or Table 3 to the expression of the at least one classifier biomarkers of Table 1 or Table 3 in at least one sample training set(s), wherein the at least one sample training set comprises expression data of the at least one classifier biomarkers of Table 1 or Table 3 from a reference HNSCC BA sample, expression data of the at least one classifier biomarkers of Table 1 or Table 3 from a reference HNSCC MS sample, expression data of the at least one classifier biomarkers of Table 1 or Table 3 from a reference HNSCC AT sample, expression data of the at least one classifier biomarkers of Table 1 or Table 3 from a reference HNSCC CL sample or a combination thereof; and classifying the sample as BA, MS, AT or CL subtype based on the results of the comparing step.

3. The method of embodiment 2, wherein the comparing step comprises applying a statistical algorithm which comprises determining a correlation between the expression data obtained from the sample and the expression data from the at least one training set(s); and classifying the sample as a BA, MS, AT or CL subtype based on the results of the statistical algorithm.

4. The method of any of the above embodiments, wherein the expression level of the classifier biomarker is detected at the nucleic acid level.

5. The method of embodiment 4, wherein the nucleic acid level is RNA or cDNA.

6. The method embodiment 4 or 5, wherein the detecting an expression level comprises performing quantitative real time reverse transcriptase polymerase chain reaction (qRT-PCR), RNAseq, microarrays, gene chips, nCounter Gene Expression Assay, Serial Analysis of Gene Expression (SAGE), Rapid Analysis of Gene Expression (RAGE), nuclease protection assays, Northern blotting, or any other equivalent gene expression detection techniques.

7. The method of embodiment 6, wherein the expression level is detected by performing qRT-PCR.

8. The method of embodiment 7, wherein the detection of the expression level comprises using at least one pair of oligonucleotide primers specific for at least one classifier biomarker of Table 1 or Table 3.

9. The method of any of the above embodiments, wherein the sample is a formalin-fixed, paraffin-embedded (FFPE) head and neck tissue sample, fresh or a frozen tissue sample, an exosome, wash fluids, cell pellets, or a bodily fluid obtained from the patient.

10. The method of embodiment 9, wherein the bodily fluid is blood or fractions thereof, urine, saliva, or sputum.

11. The method of any one of the above embodiments, wherein the at least one classifier biomarker comprises a plurality of classifier biomarkers.

12. The method of embodiment 11, wherein the plurality of classifier biomarkers comprises at least two classifier biomarkers, at least 9 classifier biomarkers, at least 18 classifier biomarkers, at least 36 classifier biomarkers, at least 54 classifier biomarkers, at least 72 classifier biomarkers, at least 90 classifier biomarkers, at least 108 classifier biomarkers, at least 126 classifier biomarkers or at least 144 classifier biomarkers of Table 1.

13. The method of any of embodiments 1-10, wherein the at least one classifier biomarker comprises all the classifier biomarkers of Table 1.

14. The method of embodiment 11, wherein the plurality of classifier biomarkers comprises at least two classifier biomarkers, at least 5 classifier biomarkers, at least 10 classifier biomarkers, at least 20 classifier biomarkers, at least 30 classifier biomarkers, at least 40 classifier biomarkers, at least 50 classifier biomarkers, at least 60 classifier biomarkers, at least 70 classifier biomarkers or at least 80 classifier biomarkers of Table 3.

15. The method of any of embodiments 1-10, wherein the at least one classifier biomarker comprises all the classifier biomarkers of Table 3.

16. The method of any of the above embodiments, wherein the method further comprises determining the HPV status of the patient.

17. The method of embodiment 16, wherein the determining the HPV status of the patient comprises measuring the expression of one or more HPV genes in the tissue sample obtained from the patient.

18. The method of embodiment 17, wherein the one or more HPV genes is the E6 gene, the E7 gene, the E6 and E7 genes or the E6 and E7 genes in combination with one or more additional genes from the HPV genome.

19. A method for determining a HNSCC subtype of a head and neck tissue sample obtained from a patient comprising detecting an expression level of at least one nucleic acid molecule that encodes a classifier biomarker having a specific expression pattern in head and neck cancer cells, wherein the classifier biomarker is selected from the group consisting of the classifier genes set forth in Table 1 or Table 3, the method comprising: (a) isolating nucleic acid material from a head and neck tissue sample from a patient; (b) mixing the nucleic acid material with oligonucleotides that are substantially complementary to portions of nucleic acid molecule of the classifier biomarker; and (c) detecting expression of the classifier biomarker.

20. The method of embodiment 19, wherein the method further comprises comparing the detected levels of expression of the at least one classifier biomarkers of Table 1 or Table 3 to the expression of the at least one classifier biomarkers of Table 1 or Table 3 in at least one sample training set(s), wherein the at least one sample training set comprises expression data of the at least one classifier biomarkers of Table 1 or Table 3 from a reference HNSCC BA sample, expression data of the at least one classifier biomarkers of Table 1 or Table 3 from a reference HNSCC MS sample, expression data of the at least one classifier biomarkers of Table 1 or Table 3 from a reference HNSCC AT sample, expression data of the at least one classifier biomarkers of Table 1 or Table 3 from a reference HNSCC CL sample or a combination thereof; and classifying the sample as BA, MS, AT or CL subtype based on the results of the comparing step.

21. The method of embodiment 20, wherein the comparing step comprises applying a statistical algorithm which comprises determining a correlation between the expression data obtained from the sample and the expression data from the at least one training set(s); and classifying the sample as a BA, MS, AT or CL subtype based on the results of the statistical algorithm.

22. The method of any of embodiments 19-21, wherein the detecting the expression level comprises performing qRT-PCR or any hybridization-based gene assays.

23. The method of embodiment 22, wherein the expression level is detected by performing qRT-PCR.

24. The method of embodiment 23, wherein the detection of the expression level comprises using at least one pair of oligonucleotide primers specific for at least one classifier biomarker of Table 1 or Table 3.

25. The method of any of embodiments 19-24, further comprising predicting the response to a therapy for treating a subtype of HNSCC based on the detected expression level of the classifier biomarker.

26. The method of embodiment 25, wherein the therapy is radiotherapy, surgical intervention, chemotherapy, angiogenesis inhibitors and/or immunotherapy.

27. The method of any one of embodiments 19-26, wherein the sample is a formalin-fixed, paraffin-embedded (FFPE) head and neck tissue sample, fresh or a frozen tissue sample, an exosome, wash fluids, cell pellets or a bodily fluid obtained from the patient.

28. The method of embodiment 27, wherein the bodily fluid is blood or fractions thereof, urine, saliva, or sputum.

29. The method of any of embodiments 19-28, wherein the at least one nucleic acid molecule that encodes a classifier biomarker comprises a plurality of nucleic acid molecules that encode a plurality of classifier biomarkers.

30. The method of embodiment 29, wherein the plurality of classifier biomarkers comprises at least two classifier biomarkers, at least 9 classifier biomarkers, at least 18 classifier biomarkers, at least 36 classifier biomarkers, at least 54 classifier biomarkers, at least 72 classifier biomarkers, at least 90 classifier biomarkers, at least 108 classifier biomarkers, at least 126 classifier biomarkers or at least 144 classifier biomarkers of Table 1.

31. The method of any of embodiments 19-28, wherein the at least one classifier biomarker comprises all the classifier biomarkers of Table 1.

32. The method of embodiment 29, wherein the plurality of classifier biomarkers comprises at least two classifier biomarkers, at least 5 classifier biomarkers, at least 10 classifier biomarkers, at least 20 classifier biomarkers, at least 30 classifier biomarkers, at least 40 classifier biomarkers, at least 50 classifier biomarkers, at least 60 classifier biomarkers, at least 70 classifier biomarkers or at least 80 classifier biomarkers of Table 3.

33. The method of any of embodiments 19-28, wherein the at least one classifier biomarker comprises all the classifier biomarkers of Table 3.

34. The method of embodiments 19-33, wherein the method further comprises determining the HPV status of the patient.

35. The method of embodiment 34, wherein the determining the HPV status of the patient comprises measuring the expression of one or more HPV genes in the tissue sample obtained from the patient.

36. The method of embodiment 35, wherein the one or more HPV genes is the E6 gene, the E7 gene, the E6 and E7 genes or the E6 and E7 genes in combination with one or more additional genes from the HPV genome.

37. A method of detecting a biomarker in a head and neck tissue sample obtained from a patient, the method comprising measuring the expression level of a plurality of biomarker nucleic acids selected from Table 1 or Table 3 using an amplification, hybridization and/or sequencing assay.

38. The method of embodiment 37, wherein the head neck tissue sample was previously diagnosed as being squamous cell carcinoma.

39. The method of embodiment 38, wherein the previous diagnosis was by histological examination.

40. The method of any of embodiments 37-39, wherein the amplification, hybridization and/or sequencing assay comprises performing quantitative real time reverse transcriptase polymerase chain reaction (qRT-PCR), RNAseq, microarrays, gene chips, nCounter Gene Expression Assay, Serial Analysis of Gene Expression (SAGE), Rapid Analysis of Gene Expression (RAGE), nuclease protection assays, Northern blotting, or any other equivalent gene expression detection techniques.

41. The method of embodiment 40, wherein the expression level is detected by performing qRT-PCR.

42. The method of embodiment 41, wherein the detection of the expression level comprises using at least one pair of oligonucleotide primers per each of the plurality of biomarker nucleic acids selected from Table 1 or Table 3.

43. The method of any of embodiments 37-42, wherein the sample is a formalin-fixed, paraffin-embedded (FFPE) head and neck tissue sample, fresh or a frozen tissue sample, an exosome, wash fluids, cell pellets, or a bodily fluid obtained from the patient.

44. The method of embodiment 43, wherein the bodily fluid is blood or fractions thereof, urine, saliva, or sputum.

45. The method of any of embodiments 37-44, wherein the plurality of biomarker nucleic acids comprises, consists essentially of or consists of at least two biomarker nucleic acids, at least 18 biomarker nucleic acids, at least 36 biomarker nucleic acids, at least 54 biomarker nucleic acids, at least 72 biomarker nucleic acids, at least 90 biomarker nucleic acids, at least 108 biomarker nucleic acids, at least 126 biomarker nucleic acids, or at least 144 biomarker nucleic acids of Table 1.

46. The method of any of embodiments 37-44, wherein the plurality of biomarker nucleic acids comprises, consists essentially of or consists of all the classifier biomarker nucleic acids of Table 1.

47. The method of any of embodiments 37-44, wherein the plurality of biomarker nucleic acids comprises, consists essentially of or consists of at least two biomarker nucleic acids, at least 10 biomarker nucleic acids, at least 20 biomarker nucleic acids, at least 30 biomarker nucleic acids, at least 40 biomarker nucleic acids, at least 50 biomarker nucleic acids, at least 60 biomarker nucleic acids, at least 70 biomarker nucleic acids, or at least 80 biomarker nucleic acids of Table 3.

48. The method of any of embodiments 37-44, wherein the plurality of biomarker nucleic acids comprises, consists essentially of or consists of all the classifier biomarker nucleic acids of Table 3.

49. The method of embodiments 37-48, wherein the method further comprises determining the HPV status of the patient.

50. The method of embodiment 49, wherein the determining the HPV status of the patient comprises measuring the expression of one or more HPV genes in the tissue sample obtained from the patient.

51. The method of embodiment 50, wherein the one or more HPV genes is the E6 gene, the E7 gene, the E6 and E7 genes or the E6 and E7 genes in combination with one or more additional genes from the HPV genome.

52. A method of detecting a biomarker in a head and neck tissue sample obtained from a patient, the method consisting essentially of measuring the expression level of a plurality of biomarker nucleic acids selected from Table 1 or Table 3 using an amplification, hybridization and/or sequencing assay.

53. The method of embodiment 52, wherein the head and neck tissue sample was previously diagnosed as being squamous cell carcinoma.

54. The method of embodiment 53, wherein the previous diagnosis was by histological examination.

55. The method of any of embodiments 52-54, wherein the amplification, hybridization and/or sequencing assay comprises performing quantitative real time reverse transcriptase polymerase chain reaction (qRT-PCR), RNAseq, microarrays, gene chips, nCounter Gene Expression Assay, Serial Analysis of Gene Expression (SAGE), Rapid Analysis of Gene Expression (RAGE), nuclease protection assays, Northern blotting, or any other equivalent gene expression detection techniques.

56. The method of embodiment 55, wherein the expression level is detected by performing qRT-PCR.

57. The method of embodiment 56, wherein the detection of the expression level comprises using at least one pair of oligonucleotide primers per each of the plurality of biomarker nucleic acids selected from Table 1 or Table 3.

58. The method of any of embodiments 52-57, wherein the sample is a formalin-fixed, paraffin-embedded (FFPE) head and neck tissue sample, fresh or a frozen tissue sample, an exosome, wash fluids, cell pellets, or a bodily fluid obtained from the patient.

59. The method of embodiment 58, wherein the bodily fluid is blood or fractions thereof, urine, saliva, or sputum.

60. The method of any of embodiments 52-59, wherein the plurality of biomarker nucleic acids comprises, consists essentially of or consists of at least two biomarker nucleic acids, at least 18 biomarker nucleic acids, at least 36 biomarker nucleic acids, at least 54 biomarker nucleic acids, at least 72 biomarker nucleic acids, at least 90 biomarker nucleic acids, at least 108 biomarker nucleic acids, at least 126 biomarker nucleic acids, or at least 144 biomarker nucleic acids of Table 1.

61. The method of any of embodiments 52-59, wherein the plurality of biomarker nucleic acids comprises, consists essentially of or consists of all the classifier biomarker nucleic acids of Table 1.

62. The method of any of embodiments 52-59, wherein the plurality of biomarker nucleic acids comprises, consists essentially of or consists of at least two biomarker nucleic acids, at least 10 biomarker nucleic acids, at least 20 biomarker nucleic acids, at least 30 biomarker nucleic acids, at least 40 biomarker nucleic acids, at least 50 biomarker nucleic acids, at least 60 biomarker nucleic acids, at least 70 biomarker nucleic acids, or at least 80 biomarker nucleic acids of Table 3.

63. The method of any of embodiments 52-59, wherein the plurality of biomarker nucleic acids comprises, consists essentially of or consists of all the classifier biomarker nucleic acids of Table 3.

64. The method of embodiments 52-63, wherein the method further comprises determining the HPV status of the patient.

65. The method of embodiment 64, wherein the determining the HPV status of the patient comprises measuring the expression of one or more HPV genes in the tissue sample obtained from the patient.

66. The method of embodiment 65, wherein the one or more HPV genes is the E6 gene, the E7 gene, the E6 and E7 genes or the E6 and E7 genes in combination with one or more additional genes from the HPV genome.

67. A method of detecting a biomarker in a head and neck tissue sample obtained from a patient, the method consisting of measuring the expression level of a plurality of biomarker nucleic acids selected from Table 1 or Table 3 using an amplification, hybridization and/or sequencing assay.

68. The method of embodiment 67, wherein the head and neck tissue sample was previously diagnosed as being squamous cell carcinoma.

69. The method of embodiment 68, wherein the previous diagnosis was by histological examination.

70. The method of any of embodiments 67-69, wherein the amplification, hybridization and/or sequencing assay comprises performing quantitative real time reverse transcriptase polymerase chain reaction (qRT-PCR), RNAseq, microarrays, gene chips, nCounter Gene Expression Assay, Serial Analysis of Gene Expression (SAGE), Rapid Analysis of Gene Expression (RAGE), nuclease protection assays, Northern blotting, or any other equivalent gene expression detection techniques.

71. The method of embodiment 70, wherein the expression level is detected by performing qRT-PCR.

72. The method of embodiment 71, wherein the detection of the expression level comprises using at least one pair of oligonucleotide primers per each of the plurality of biomarker nucleic acids selected from Table 1 or Table 3.

73. The method of any of embodiments 67-72, wherein the sample is a formalin-fixed, paraffin-embedded (FFPE) head and neck tissue sample, fresh or a frozen tissue sample, an exosome, wash fluids, cell pellets, or a bodily fluid obtained from the patient.

74. The method of embodiment 73, wherein the bodily fluid is blood or fractions thereof, urine, saliva, or sputum.

75. The method of any of embodiments 67-74, wherein the plurality of biomarker nucleic acids comprises, consists essentially of or consists of at least two biomarker nucleic acids, at least 18 biomarker nucleic acids, at least 36 biomarker nucleic acids, at least 54 biomarker nucleic acids, at least 72 biomarker nucleic acids, at least 90 biomarker nucleic acids, at least 108 biomarker nucleic acids, at least 126 biomarker nucleic acids, or at least 144 biomarker nucleic acids of Table 1.

76. The method of any of embodiments 67-74, wherein the plurality of biomarker nucleic acids comprises, consists essentially of or consists of all the classifier biomarker nucleic acids of Table 1.

77. The method of any of embodiments 67-74, wherein the plurality of biomarker nucleic acids comprises, consists essentially of or consists of at least two biomarker nucleic acids, at least 10 biomarker nucleic acids, at least 20 biomarker nucleic acids, at least 30 biomarker nucleic acids, at least 40 biomarker nucleic acids, at least 50 biomarker nucleic acids, at least 60 biomarker nucleic acids, at least 70 biomarker nucleic acids, or at least 80 biomarker nucleic acids of Table 3.

78. The method of any of embodiments 67-74, wherein the plurality of biomarker nucleic acids comprises, consists essentially of or consists of all the classifier biomarker nucleic acids of Table 3.

79. The method of embodiments 67-78, wherein the method further comprises determining the HPV status of the patient.

80. The method of embodiment 79, wherein the determining the HPV status of the patient comprises measuring the expression of one or more HPV genes in the tissue sample obtained from the patient.

81. The method of embodiment 80, wherein the one or more HPV genes is the E6 gene, the E7 gene, the E6 and E7 genes or the E6 and E7 genes in combination with one or more additional genes from the HPV genome.

82. A method of determining whether a HNSCC patient is likely to respond to immunotherapy, the method comprising,
    determining the HNSCC subtype of a head and neck tissue sample from the patient, wherein the HNSCC subtype is selected from the group consisting of basal, mesenchymal, atypical and classical; and
    based on the subtype, assessing whether the patient is likely to respond to immunotherapy.

83. A method for selecting a HNSCC patient for immunotherapy, the method comprising, determining a HNSCC subtype of a head and neck tissue sample from the patient, based on the subtype; and selecting the patient for immunotherapy.

84. The method of embodiment 82 or 83, wherein the immunotherapy comprises checkpoint inhibitor therapy.

85. The method of embodiment 84, wherein the checkpoint inhibitor targets PD-1 or PD-L1.

86. The method of embodiment 84, wherein the checkpoint inhibitor targets CTLA-4.

87. The method of embodiment 85, wherein the checkpoint inhibitor is Pembrolizumab, Nivolumab or an antigen fragment binding fragment thereof.

88. The method of embodiment 86, wherein the checkpoint inhibitor is Ipilimumab or an antigen binding fragment thereof.

89. The method of any one of embodiments 82-88, wherein the patient is initially determined to have HNSCC via a histological analysis of a sample.

90. The method of any one of embodiments 82-89, wherein the patient's HNSCC molecular subtype is selected from basal, mesenchymal, atypical or classical and is determined via a histological analysis of a sample obtained from the patient.

91. The method of any one of embodiments 89-90, wherein the sample is a formalin-fixed, paraffin-embedded (FFPE) head and neck tissue sample, fresh or a frozen tissue sample, an exosome, or a bodily fluid obtained from the patient.

92. The method of embodiment 91, wherein the bodily fluid is blood or fractions thereof, urine, saliva, or sputum.

93. The method of any one of embodiments 82-92, wherein the determining the HNSCC subtype comprises determining expression levels of a plurality of classifier biomarkers.

94. The method of embodiment 93, wherein the determining the expression levels of the plurality of classifier biomarkers is at a nucleic acid level by performing RNA sequencing, reverse transcriptase polymerase chain reaction (RT-PCR) or hybridization based analyses.

95. The method of embodiment 93 or 94, wherein the plurality of classifier biomarkers for determining the HNSCC subtype is selected from a publically available HNSCC dataset.

96. The method of embodiment 95, wherein the publically available HNSCC dataset is TCGA HNSCC RNAseq dataset.

97. The method of embodiment 94, wherein the plurality of classifier biomarkers for determining the HNSCC subtype is selected from Table 1 or Table 3.

98. The method of embodiment 97, wherein the RT-PCR is quantitative real time reverse transcriptase polymerase chain reaction (qRT-PCR).

99. The method of embodiment 98, wherein the RT-PCR is performed with primers specific to the plurality of classifier biomarkers of Table 1 or Table 3.

100. The method of any one of embodiments 93-99, further comprising comparing the detected levels of expression of the plurality of classifier biomarkers of Table 1 or Table 3 to the expression of the plurality of classifier biomarkers of Table 1 or Table 3 in at least one sample training set(s), wherein the at least one sample training set comprises expression data of the plurality of classifier biomarkers of Table 1 or Table 3 from a reference HNSCC BA sample, expression data of the plurality of classifier biomarkers of Table 1 or Table 3 from a reference HNSCC MS sample, expression data of the plurality of classifier biomarkers of Table 1 or Table 3 from a reference HNSCC AT sample, expression data of the plurality of classifier biomarkers of Table 1 or Table 3 from a reference HNSCC CL sample or a combination thereof; and classifying the first sample as BA, MS, AT or CL based on the results of the comparing step.

101. The method of embodiment 100, wherein the comparing step comprises applying a statistical algorithm which comprises determining a correlation between the expression data obtained from the sample and the expression data from the at least one training set(s); and classifying the sample as a BA, MS, AT or CL subtype based on the results of the statistical algorithm.

102. The method of any of embodiments 93-101, wherein the plurality of the classifier biomarkers comprise each of the classifier biomarkers set forth in Table 1 or Table 3.

103. The method of embodiments 82-102, wherein the method further comprises determining the HPV status of the patient.

104. The method of embodiment 103, wherein the determining the HPV status of the patient comprises measuring the expression of one or more HPV genes in the tissue sample obtained from the patient.

105. The method of embodiment 104, wherein the one or more HPV genes is the E6 gene, the E7 gene, the E6 and E7 genes or the E6 and E7 genes in combination with one or more additional genes from the HPV genome.

106. A method of treating HNSCC in a subject, the method comprising:
measuring the expression level of at least one biomarker nucleic acid in a HNSCC sample obtained from the subject, wherein the at least one biomarker nucleic acid is selected from a set of biomarkers listed in Table 1 or Table 3, wherein the presence, absence and/or level of the at least one biomarker indicates a subtype of the HNSCC; and
administering an immunotherapeutic agent based on the subtype of the HNSCC.

107. The method of embodiment 106, wherein the head and neck sample is a HNSCC sample.

108. The method of embodiment 107, wherein the at least one biomarker nucleic acid selected from the set of biomarkers comprises, consists essentially of or consists of at least two biomarker nucleic acids, at least 18 biomarker nucleic acids, at least 36 biomarker nucleic acids, at least 54 biomarker nucleic acids, at least 72 biomarker nucleic acids, at least 90 biomarker nucleic acids, at least 108 biomarker nucleic acids, at least 126 biomarker nucleic acids, or at least 144 biomarker nucleic acids of Table 1.

109. The method of embodiment 107, wherein the at least one biomarker nucleic acid selected from the set of biomarkers comprises, consists essentially of or consists of at least two biomarker nucleic acids, at least 10 biomarker nucleic acids, at least 20 biomarker nucleic acids, at least 30 biomarker nucleic acids, at least 40 biomarker nucleic acids, at least 50 biomarker nucleic acids, at least 60 biomarker nucleic acids, at least 70 biomarker nucleic acids, or at least 80 biomarker nucleic acids of Table 3.

110. The method of any of embodiments 106-109, wherein the head and neck tissue sample was previously diagnosed as HNSCC.

111. The method of embodiment 109, wherein the previous diagnosis was by histological examination.

112. The method of any one of embodiments 106-110, further comprising measuring the expression of at least one biomarker from an additional set of biomarkers.

113. The method of embodiment 112, wherein the additional set of biomarkers comprise gene expression signatures of Innate Immune Cells (IIC), Adaptive Immune Cells (AIC), one or more individual immune biomarkers, one or more interferon (IFN) genes, one or more major histocompatibility complex, class II (MHCII) genes or a combination thereof.

114. The method of embodiment 113, wherein the additional set of biomarkers comprises genes selected from Tables 6A, 6B, 7, 8, 9, or a combination thereof.

115. The method of embodiment 113, wherein the gene expression signatures of AICs are selected from Table 6A.

116. The method of embodiment 113, wherein the gene expression signature of IICs are selected from Table 6B.

117. The method of embodiment 113, wherein the one or more individual immune biomarkers are selected from Table 7.

118. The method of embodiment 113, wherein the one or more IFN genes are selected from Table 8.

119. The method of embodiment 113, wherein the one or more MHCII genes are selected from Table 9.

120. The method of any of embodiments 106-119, wherein the measuring the expression level is conducted using an amplification, hybridization and/or sequencing assay.

121. The method of embodiment 120, wherein the amplification, hybridization and/or sequencing assay comprises performing quantitative real time reverse transcriptase polymerase chain reaction (qRT-PCR), RNAseq, microarrays, gene chips, nCounter Gene Expression Assay, Serial Analysis of Gene Expression (SAGE), Rapid Analysis of Gene Expression (RAGE), nuclease protection assays, Northern blotting, or any other equivalent gene expression detection techniques.

122. The method of embodiment 121, wherein the expression level is detected by performing qRT-PCR.

123. The method of any of embodiments 106-122, wherein the sample is a formalin-fixed, paraffin-embedded (FFPE) head and neck tissue sample, fresh or a frozen tissue sample, an exosome, wash fluids, cell pellets, or a bodily fluid obtained from the patient.

124. The method of embodiment 123, wherein the bodily fluid is blood or fractions thereof, urine, saliva, or sputum.

125. The method of any one of embodiments 106-124, wherein the subject's HNSCC subtype is selected from basal, mesenchymal, atypical or classical.

126. The method of embodiment 106, wherein the at least one biomarker nucleic acid is a plurality of biomarker nucleic acids, wherein the plurality of biomarker nucleic acids comprises at least one biomarker nucleic acid listed in Table 1 or Table 3 in combination with one or more biomarker nucleic acids from a publically available HNSCC dataset, wherein the presence, absence and/or level of the plurality of biomarker nucleic acids indicates a subtype of the HNSCC.

127. The method of embodiment 106, wherein the at least one biomarker nucleic acid is a plurality of biomarker nucleic acids, wherein the plurality of biomarker nucleic acids comprises all of the biomarker nucleic acids listed in Table 1 or Table 3 in combination with one or more biomarker nucleic acids from a publically available HNSCC dataset, wherein the presence, absence and/or level of the plurality of biomarker nucleic acids indicates a subtype of the HNSCC.

128. The method of embodiment 126 or 127, wherein the publically available HNSCC dataset is TCGA HNSCC RNAseq dataset.

129. The method of embodiments 106-128, wherein the method further comprises determining the HPV status of the patient.

130. The method of embodiment 129, wherein the determining the HPV status of the patient comprises measuring the expression of one or more HPV genes in the tissue sample obtained from the patient.

131. The method of embodiment 130, wherein the one or more HPV genes is the E6 gene, the E7 gene, the E6 and E7 genes or the E6 and E7 genes in combination with one or more additional genes from the HPV genome.

The various embodiments described above can be combined to provide further embodiments. All of the U.S. patents, U.S. patent application publications, U.S. patent application, foreign patents, foreign patent application and non-patent publications referred to in this specification and/or listed in the Application Data Sheet are incorporated herein by reference, in their entirety. Aspects of the embodiments can be modified, if necessary to employ concepts of the various patents, application and publications to provide yet further embodiments.

These and other changes can be made to the embodiments in light of the above-detailed description. In general, in the following claims, the terms used should not be construed to limit the claims to the specific embodiments disclosed in the specification and the claims, but should be construed to include all possible embodiments along with the full scope of equivalents to which such claims are entitled. Accordingly, the claims are not limited by the disclosure.

SEQUENCE LISTING (144 sequences)

SEQ ID NO: 1 - DNA, 6564 bp, Homo sapiens
ccaggcggcgttgcggccccggccccggctccctgcgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgttcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgattttttttttttaagtactgttccggggagaaaaacagtctcaaaacttgaacttcttgggaatagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttctaaa

SEQ ID NO: 2 - DNA, 5872 bp, Homo sapiens
gggaatgctttgtgcagcgcgcttgcgcggtgtggcggccgatgccgctataaaggcttgttttgctgcagggctcatgctcgggagcgtggttgagcggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccagccttcatggtgaaacacctcttggagtatacccaggcaacagagtctaacctgcagtacagcttgttgttagtgctgggcctcctcctgacggaaatcgtgcggtcttggtcgcttgcactgacttgggcattgaattaccgaaccggtgtccgcttgcggggggccatcctaaccatggcatttaagaagatccttaagttaaagaacattaaagagaaatccctgggtgagctcatcaacatttgctccaacgatgggcagagaatgtttgaggcagcagccgttggcagcctgctggctggaggacccgttgttgccatcttaggcatgatttataatgtaattattctgggaccaacaggcttcctgggatcagctgtttttatcctcttttacccagcaatgatgtttgcatcacggctcacagcatatttcaggagaaaatgcgtggccgccacggatgaacgtgtccagaagatgaatgaagttcttacttacattaaatttatcaaaatgtatgcctgggtcaaagcattttctcagagtgttcaaaaaatccgcgaggaggagcgtcggatattggaaaaagctgggtacttccagagcatcactgtgggtgtggctcccattgtggtggtgattgccagcgtggtgaccttctctgttcatatgaccctgggcttcgatctgacagcagcacaggctttcacagtggtgacagtcttcaattccatgacttttgctttgaaagtaacaccgttttcagtaaagtccctctcagaagcctcagtggctgttgacagatttaagagtttgtttctaatggaagaggttcacatgataaagaacaaaccagccagtcctcacatcaagatagagatgaaaaatgccaccttggcatgggactcctcccactccagtatccagaactcgcccaagctgacccccaaaatgaaaaaagacaagagggcttccaggggcaagaaagagaaggtgaggcagctgcagcgcactgagcatcaggcggtgctggcagagcagaaaggccacctcctcctggacagtgacgagcggcccagtcccgaagaggaagaaggcaagcacatccacctgggccacctgcgcttacagaggacactgcacagcatcgatctggagatccaagagggtaaactggttggaatctgtggcagtgtgggaagtggaaaaacctctctcatttcagccattttaggccagatgacgcttctagagggcagcattgcaatcagtggaaccttcgcttatgtggcccagcaggcctggatcctcaatgctactctgagagacaacatcctgtttgggaaggaatatgatgaagaaagatacaactctgtgctgaacagctgctgcctgaggcctgacctggccattcttcccagcagcgacctgacggagattggagagcgaggagccaacctgagcggtgggcagcgccagaggatcagccttgcccgggccttgtatagtgacaggagcatctacatcctggacgaccccctcagtgccttagatgcccatgtgggcaaccacatcttcaatagtgctatccggaaacatctcaagtccaagacagttctgtttgttacccaccagttacagtacctggttgactgtgatgaagtgatcttcatgaaagagggctgtattacggaaagaggcacccatgaggaactgatgaatttaaatggtgactatgctaccatttttaataacctgttgctgggagagacaccgccagttgagatcaattcaaaaaaggaaaccagtggttcacagaagaagtcacaagacaagggtcctaaaacaggatcagtaaagaaggaaaaagcagtaaagccagaggaagggcagcttgtgcagctggaagagaaagggcagggttcagtgccctggtcagtatatggtgtctacatccaggctgctgggggccccttggcattcctggttattatggcccttttcatgctgaatgtaggcagcaccgccttcagcacctggtggttgagttactggatcaagcaaggaagcgggaacaccactgtgactcgagggaacgagacctcggtgagtgacagcatgaaggacaatcctcatatgcagtactatgccagcatctacgccctctccatggcagtcatgctgatcctgaaagccattcgaggagttgtctttgtcaagggcacgctgcgagcttcctcccggctgcatgacgagcttttccgaaggatccttcgaagccctatgaagttttttgacacgacccccacagggaggattctcaacaggttttccaaagacatggatgaagttgacgtgcggctgccgttccaggccgagatgttcatccagaacgttatcctggtgttcttctgtgtgggaatgatcgcaggagtcttcccgtggttccttgtggcagtggggccccttgtcatcctcttttcagtcctgcacattgtctccagggtcctgattcgggagctgaagcgtctggacaatatcacgcagtcacctttcctctcccacatcacgtccagcatacagggccttgccaccatccacgcctacaataaagggcaggagtttctgcacagataccaggagctgctggatgacaaccaagctcctttttttttgtttacgtgtgcgatgcggtggctggctgtgcggctggacctcatcagcatcgccctcatcaccaccacggggctgatgatcgttcttatgcacgggcagattcccccagcctatgcgggtctcgccatctcttatgctgtccagttaacggggctgttccagtttacggtcagactggcatctgagacagaagctcgattcacctcggtggagaggatcaatcactacattaagactctgtccttggaagcacctgccagaattaagaacaaggctccctcccctgactggccccaggagggagaggtgacctttgagaacgcagagatgaggtaccgagaaaacctccctctcgtcctaaagaaagtatccttcacgatcaaacctaaagagaagattggcattgtggggcggacaggatcagggaagtcctcgctggggatggccctcttccgtctggtggagttatctggaggctgcatcaagattgatggagtgagaatcagtgatattggccttgccgacctccgaagcaaactctctatcattcctcaagagccggtgctgttcagtggcactgtcagatcaaatttggaccccttcaaccagtacactgaagaccagatttgggatgccctggagaggacacacatgaaagaatgtattgctcagctacctctgaaacttgaatctgaagtgatggagaatggggataacttctcagtgggggaacggcagctcttgtgcatagctagagccctgctccgccactgtaagattctgattttagatgaagccacagctgccatggacacagagacagacttattgattcaagagaccatccgagaagcatttgcagactgtaccatgctgaccattgcccatcgcctgcacacggttctaggctccgataggattatggtgctggcccagggacaggtggtggagtttgacaccccatcggtccttctgtccaacgacagttcccgattctatgccatgtttgctgctgcagagaacaaggtcgctgtcaagggctgactcctccctgttgacgaagtctcttttctttagagcattgccattccctgcctggggcgggcccctcatcgcgtcctcctaccgaaaccttgcctttctcgattttatctttcgcacagcagttccggattggcttgtgtgtttcacttttagggagagtcatattttgattattgtatttattccatattcatgtaaacaaaatttagtttttgttcttaattgcactctaaaaggttcagggaaccgttattataattgtatcagaggcctataatgaagctttatacgtgtagctatatctatatataattctgtacatagcctatatttacagtgaaaatgtaagctgtttattttatattaaaataagcactgtgctaataacagtgcatattcctttctatcatttttgtacagtttgctgtactagagatctggttttgctattagactgtaggaagagtagcatttcattcttctctagctggtggtttcacggtgccaggttttctgggtgtccaaaggaagacgtgtggcaatagtgggccctccgacagccccctctgccgcctccccacggccgctccaggggtggctggagacgggtgggcggctggagaccatgcagagcgccgtgagttctcagggctcctgccttctgtcctggtgtcacttactgtttctgtcaggagagcagcggggcgaagcccaggccccttttcactccctccatcaagaatggggatcacagagacattcctccgagccggggagtttctttcctgccttcttctttttgctgttgtttctaaacaagaatcagtctatccacagagagtcccactgcctcaggttcctatggctggccactgcacagagctctccagctccaagacctgttggttccaagccctggagccaactgctgctttttgaggtggcactttttcatttgcctattcccacacctccacagttcagtggcagggctcaggatttcgtgggtctgttttcctttctcaccgcagtcgtcgcacagtctctctctctctctcccctcaaagtctgcaactttaagcagctcttgctaatcagtgtctcacactggcgtagaagtttttgtactgtaaagagacctacctcaggttgctggttgctgtgtggtttggtgtgttcccgcaaaccccctttgtgctgtggggctggtagctcaggtgggcgtggtcactgctgtcatcaattgaatggtcagcgttgcatgtcgtgaccaactagacattctgtcgccttagcatgtttgctgaacaccttgtggaagcaaaaatctgaaaatgtgaataaaattattttggattttgtaaaaaaaaaa

SEQ ID NO: 3 - DNA, 3809 bp, Homo sapiens
tctgccccttccccccgcccccgcccgcctcggctcccgcagcgctagtgtgtccgcctagttcagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccgttgctcagagagaaggtggaggaagaaatccagaccctagcacgcgcgcaccatcatggaccattatgattctcagcaaaccaacgattacatgcagccagaagaggactgggaccgggacctgctcctggacccggcctgggagaagcagcagagaaagacattcacggcatggtgtaactcccacctccggaaggcggggacacagatcgagaacatcgaagaggacttccgggatggcctgaagctcatgctgctgctggaggtcatctcaggtgaacgcttggccaagccagagcgaggcaagatgagagtgcacaagatctccaacgtcaacaaggccctggatttcatagccagcaaaggcgtcaaactggtgtccatcggagccgaagaaatcgtggatgggaatgtgaagatgaccctgggcatgatctggaccatcatcctgcgctttgccatccaggacatctccgtggaagagacttcagccaaggaagggctgctcctgtggtgtcagagaaagacagccccttacaaaaatgtcaacatccagaacttccacataagctggaaggatggcctcggcttctgtgctttgatccaccgacaccggcccgagctgattgactacgggaagctgcggaaggatgatccactcacaaatctgaatacggcttttgacgtggcagagaagtacctggacatccccaagatgctggatgccgaagacatcgttggaactgcccgaccggatgagaaagccatcatgacttacgtgtctagcttctaccacgccttctctggagcccagaaggcggagacagcagccaatcgcatctgcaaggtgttggccgtcaaccaggagaacgagcagcttatggaagactacgagaagctggccagtgatctgttggagtggatccgccgcacaatcccgtggctggagaaccgggtgcccgagaacaccatgcatgccatgcaacagaagctggaggacttccgggactaccggcgcctgcacaagccgcccaaggtgcaggagaagtgccagctggagatcaacttcaacacgctgcagaccaagctgcggctcagcaaccggcctgccttcatgccctctgagggcaggatggtctcggacatcaacaatgcctggggctgcctggagcaggtggagaagggctatgaggagtggttgctgaatgagatccggaggctggagcgactggaccacctggcagagaagttccggcagaaggcctccatccacgaggcctggactgacggcaaagaggccatgctgcgacagaaggactatgagaccgccaccctctcggagatcaaggccctgctcaagaagcatgaggccttcgagagtgacctggctgcccaccaggaccgtgtggagcagattgccgccatcgcacaggagctcaatgagctggactattatgactcacccagtgtcaacgcccgttgccaaaagatctgtgaccagtgggacaatctgggggccctaactcagaagcgaagggaagctctggagcggaccgagaaactgctggagaccattgaccagctgtacttggagtatgccaagcgggctgcacccttcaacaactggatggagggggccatggaggacctgcaggacaccttcattgtgcacaccattgaggagatccagggactgaccacagcccatgagcagttcaaggccaccctccctgatgccgacaaggagcgcctggccatcctgggcatccacaatgaggtgtccaagattgtccagacctaccacgtcaatatggcgggcaccaacccctacacaaccatcacgcctcaggagatcaatggcaaatgggaccacgtgcggcagctggtgcctcggagggaccaagctctgacggaggagcatgcccgacagcagcacaatgagaggctacgcaagcagtttggagcccaggccaatgtcatcgggccctggatccagaccaagatggaggagatcgggaggatctccattgagatgcatgggaccctggaggaccagctcagccacctgcggcagtatgagaagagcatcgtcaactacaagccaaagattgatcagctggagggcgaccaccagctcatccaggaggcgctcatcttcgacaacaagcacaccaactacaccatggagcacatccgtgtgggctgggagcagctgctcaccaccatcgccaggaccatcaatgaggtagagaaccagatcctgacccgggatgccaagggcatcagccaggagcagatgaatgagttccgggcctccttcaaccactttgaccgggatcactccggcacactgggtcccgaggagttcaaagcctgcctcatcagcttgggttatgatattggcaacgacccccagaagaagacaggcatgatggacacggatgatttccgcgcctgcctgatctccatgggttacaacatgggagaagcagaatttgcccgcatcatgagcattgtggaccccaaccgcctgggggtagtgacattccaggccttcattgacttcatgtcccgcgagacagccgacacagatacagcagaccaagtcatggcttccttcaagatcctggctggggacaagaactacattaccatggacgagctgcgccgcgagctgccacccgaccaggctgagtactgcatcgcgcggatggccccctacaccggccccgactccgtgccaggtgctctggactacatgtccttctccacggcgctgtacggcgagagtgacctctaatccaccccgcccggccgccctcgtcttgtgcgccgtgccctgccttgcacctccgccgtcgcccatctcctgcctgggttcggtttcagctcccagcctccacccgggtgagctggggcccacgtggcatcgatcctccctgcccgcgaagtgacagtttacaaaattattttctgcaaaaaagaaaaaaaagttacgttaaaaaccaaaaaactacatattttattatagaaaaagtattttttctccaccagacaaatggaaaaaaagaggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattttatgatattaaagaaaatcttttgaaatggctgttttttaaggaagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaaaccacactcctatgacaaaaaaaaaaaaaaaaaaa

SEQ ID NO: 4 - DNA, 2891 bp, Homo sapiens
gctccctcgccgccctgaaccggcggctagactgcgcatgcgtgtcagtggcgctagcggcggacccggctgggcagttccttccccagaaggagagattcctctgccatggagtcctacgatgtgatcgccaaccagcctgtcgtgatcgacaacggatccggtgtgattaaagctggttttgctggtgatcagatccccaaatactgctttccaaactatgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccccaaaaggatgagacgctagagacagagaaagctcagtactacctgcctgatggcagcaccattgagattggtccttcccgattccgggcccctgagttgctcttcaggccagatttgattggagaggagagtgaaggcatccacgaggtcctggtgttcgccattcagaagtcagacatggacctgcggcgcacgcttttctctaacattgtcctctcaggaggctctaccctgttcaaaggttttggtgacaggctcctgagtgaagtgaagaaactagctccaaaagatgtgaagatcaggatatctgcacctcaggagagactgtattccacgtggattgggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgtgcacatgcgagtgccgtgtggccctgggaccctgggcccagaaaggacgatgaactacctgcagtggtgatggcctgaggcctggggttgaccactaactggctcctgacagggaagagcgctggcagaggctgtgctccctcctcaggtggcctctggctggctgtgggggactccgtttactaccacagggagacagagggaggtaagccatcccccgggagaccttgctgctgaccatcctaggctgggctggccccaccctcacccccacccccagggtgccctgaggccccaggcagctgctgcctccactatcgatgcctcctgactgcacactgaggactgggactggggttgagttctgtctggttttgttgccattttggtttgggaggctggaaaagcaccccaagagctattacagagactggagtcaggagagagcaggaggccctcatgttcaccagggaacaggaccacaccggccactggaggagggcaggagcagtcctcactctgaatggctgcagagttaatgttcccagcccagtcccctttcgggggccttgggagagtttaaggcacctgctggttccaggacctcgctttccatctgttcttgttgcaatgccatcttcaaaccgttttatttattgaagtgtttgttcagttaggggctggagagagggagcttgctgcctcctgccttgctacactaatgtttacagcacctaagcttagcctccagggccccacctctcccagctgatggtgagctgacagtgtccacaggttccaggaccatttgagattggaagctacactcaaagacactcccaccaggctctttctcccttttcctcttgctcactgccctggaatcaacaggctggttgctggttagattttctgaaacaggaggtaaaatttttctttggcagaggcccctaagcaagggaggggtgttggagagccagtgcccttaagactggagaaagctgcaatttaccaagttgccttttgccactgtagctgaccaggggactaggttgtagaggtgggaaggccccctctgggctgatcttgtgccattcttgaccttggacctgcttggttaaggagggagtgggccagaccagagtgccaggagctaatggagccaggcctgactcctaggagtggtccaaaggccttcagcctagatggtgcaaagctggggccagcctgtcttcaccggcaccctcacctgtgacaccaagacccaccccaatcccagacttcacacagtattctcccccacgccgtcctatgaccaaaggcccctgccaggtgtgggccacagcagcaggtatgtgtgaaagcaacgtagcgccccgcggactgcagtgcgcttaaccaactcacctcccttctcttagcccaagcctgtccctcgcacagcctcgcacaaaccacattgcctggtggggcccagtgtactgaaataaagtcgttccgatagacacgtcaaaaaaaaaaaaaaaaaaa

SEQ ID NO: 5 - DNA, 5432 bp, Homo sapiens
gaggggacggcagtgccacccaatcagaaacatggtcggtgcccgtggaacaatgagctactgatgagggtgtggcctggaaaacggcttttagacaaaactgtcattttatgggtcagctatagacagacatggcgcttcagctgtcttcagaataatgtcacccggcctcctctcctgtcttctgcagtcttaaaagacctagtccctaactgaggtctggcttttcctcagccctggatgaagtggagaagacctatttggagactgcttcctgtcaccataaaatcctgaacatttgtcttgaacatgaacactccaaaagaagaattccaggactggcccatagtcagaatagcagctcatttaccagacctcattgtctatggacatttctccccagagcgaccctttatggattattttgacggagtcctgatgtttgttgatatttcaggttttactgcaatgactgagaagttcagcagtgccatgtacatggacagaggggctgagcagttggtggagatcctcaactaccacataagtgcaatagtggagaaagtgttgatttttggaggagacatcctgaaatttgcaggtgatgcactgctagccctgtggagggtggagcgaaagcagctgaaaaacattatcacagtggtaattaaatgtagcctggagatccatggattgtttgagacccaggagtgggaagaaggcctagacatccgagtcaagataggactggctgctggccacatcagcatgttggtctttggagatgaaacacacagccactttctggtgattggtcaggcagtggacgatgtgcgccttgcccagaacatggctcagatgaatgatgttattctgtcaccaaactgctggcagctctgtgaccggagcatgattgaaattgagagtgttccagatcagagagcagttaaggttaacttcttaaaaccaccccccaattttaattttgatgaatttttcacaaagtgtacgaccttcatgcattattatccttctggtgagcacaaaaacctcctgaggcttgcatgcacgctgaagcctgatcctgaactggagatgtccctacaaaagtatgtgatggaaagcattttgaagcagattgataacaaacagcttcagggctatttatctgagcttcgcccagtgacgattgtgtttgtgaacctgatgtttgaagaccaagacaaagcagaagagataggcccagccatccaggatgcctatatgcacatcacttctgtcctgaagatcttccaaggccaaatcaataaagtcttcatgtttgacaagggctgctctttcctctgtgtctttggcttccctggggaaaaggtacctgacgagctcactcatgctctggaatgtgctatggatatatttgacttctgctctcaagtccacaaaatccaaactgtatccatcggtgttgccagtgggattgtcttctgtgggatcgttggacacactgtgagacacgagtacacagtcattggtcaaaaagtcaacttagctgccaggatgatgatgtactacccaggaattgtgacctgcgactctgtcacctacaatgggagcaacctaccagcgtacttttttaaagagcttccaaagaaagttatgaaaggtgttgcagattctggaccattgtatcagtattggggccgtactgagaaagtcatgtttggtatggcgtgcctcatctgcaacagaaaggaggattaccctttgctgggacgtaataaagagatcaactacttcatgtatactatgaagaaatttttgatatctaacagcagccaagtcttaatgtatgagggattaccaggatatggaaaaagccagatacttatgaaaattgagtacctggcccaaggtaagaatcacaggattattgccatttcattgaataagatcagcttccatcaaactttctataccatccagatgttcatggccaatgtcctaggcctagacacttgtaaacattataaagaacgacagaccaaccttcgaaataaagtcatgacactgttggatgaaaagttctactgtcttcttaatgacattttccatgttcagttccctatttctcgggagatttccaggatgagcaccttgaaaaagcaaaaacaattggaaatattgtttatgaagatcttgaagctgatagtgaaagaggaaaggattatttttatcattgatgaggcccagtttgtggattcgacctcctggagatttatggagaagcttatccggactcttcctatcttcatcattatgtccctgtgtcccttcgttaacattccctgtgcagctgccagggccgtaataaagaacaggaacaccacctacattgtcattggtgcagtacagcctaacgacatctccaacaagatctgtcttgacctcaatgtgagctgcatctccaaagaactggactcgtacctgggggagggaagctgtgggattccattttactgtgaagaattgcttaaaaacctggaacatcatgaggtactcgttttccaacaaacggagtctgaggaaaagacaaataggacctggaataacctgttcaagtattccattaagctaacagagaagttaaacatggttactctccatagtgataaggaaagtgaagaagtctgtcacctcacaagtggtgtcagactgaaaaacctgtcacctccaacgtcattaaaagaaatctctctgatccagctggatagcatgagactttcccaccaaatgctggtgagatgtgctgccatcattggcctgaccttcaccactgagttgttgtttgagattctcccctgttggaatatgaagatgatgatcaagaccctggcaaccctagtggaatctaacattttttattgtttccggaatggcaaggagcttcaaaaggccctgaaacagaatgatccctcatttgaggtgcactatcgttccttgtctctgaagcccagtgaagggatggatcacggtgaagaggaacagcttcgtgaactggagaatgaggtgatcgagtgccacaggattcgattctgtaaccctatgatgcagaaaacagcctacgagctgtggctcaaggaccagagaaaagccatgcacttgaaatgtgcccgctttttagaagaagatgcccacagatgtgaccactgccgaggcagggacttcattccctatcatcacttcacagtgaatattcggctcaacgctttagacatggatgccattaaaaagatggctatgtctcatggatttaaaactgaagaaaagcttatcttgtccaactcagagattcctgagacatctgcattttttcctgaaaatcgcagtcctgaagaaataagagaaaagatcttgaatttctttgaccacgttttaacaaaaatgaagacatctgacgaagacattatccctctggaatcttgccagtgtgaagaaatcctagagattgtcatcttgcctctggcccaccattttctggctttgggagaaaatgacaaagccttatattacttcttagaaattgcatctgcttatctcatcttttgtgataactacatggcatacatgtatttgaatgaaggacagaagttgctaaaaactctcaagaaggacaaatcttggagccagacatttgagtctgccaccttttacagcctcaaaggtgaggtctgtttcaatatgggccagatagtgcttgccaagaaaatgctgaggaaggcactgaagctcctcaaccgaatctttccttacaacttaatctccttgtttctccatatccatgtcgagaaaaacagacactttcattatgtgaatcggcaggcccaagagagcccacctccagggaagaagaggctggcacaactttaccggcaaactgtctgcctttccttgctgtggcgcatctatagctacagttatctttttcactgcaagtattatgcccacctggcagttatgatgcaaatgaatactgcactggaaactcaaaattgtttccagatcattaaggcttacctagactattcgctataccaccacctggctggctacaaaggtgtgtggttcaaatatgaagtcatggccatggagcacatcttcaacctccccctgaaaggcgagggcattgaaatcgtggcatacgtggctgagacactggtcttcaacaagctcataatgggacacctggatttggccattgagttaggctcccgagcccttcagatgtgggcactgctccagaatcccaaccgacattatcagtccctctgcagacttagcagatgtctccttctgaacagcagatacccgcaattgatccaggtgctggggcggctgtgggagctttctgtaacacaggaacacatcttcagcaaggcatttttctattttgtctgcttggacatcctgctttattctggttttgtttatagaacatttgaagaatgtttggaattcatacaccaatacgaaaacaacagaatcctcaagttccacagtggactcctcctgggactttattcctctgtagctatctggtatgccagacttcaggaatgggacaacttttacaaattttccaatagagctaaaaatcttttgccaagaagaaccatgacacttacttactatgacggaatatctaggtacatggaggggcaagttcttcaccttcaaaaacaaatcaaagaacagtcagagaatgcccaagccagtggggaggagctactcaagaacttggagaatctggtggctcaaaataccactggccctgtcttttgcccaaggctctaccacctgatggcttacgtctgtatattaatgggagatgggcagaaatgtggcctcttcctgaacacagccttgcggctctctgaaacacaggggaatatactggagaaatgctggctgaacatgaacaaagaatcatggtactcaacctctgagttaaaagaagaccaatggcttcagacgatcttgagtctcccatcatgggaaaaaattgtagcaggcagggtaaacattcaggatcttcaaaaaaacaaattcctgatgagagctaataccgtggacaatcatttctaacatgtcaaagaaaaaagattttaataagcactatgtccttgtgattatctattattgacctttctccgtggctggcccactccaggttcctacataatctcttctgttccagacacagaaacagacatgttgatttcttctctttctggagggcctacaagggtcaggagtgtcatggtttacttcttcctaatgttacaaaaaattgcttttaccattcatgttgttttagcttgacctgtttatttcagcccatgcaaaactgtatcatattacaaattattaatctc

SEQ ID NO: 6 - DNA, 1384 bp, Homo sapiens
gtaagaaacggttgaactggatgcaatttttatcacagcttgtgtaagactgcctctgtccctcctctcacatgccattggttaaccagcagacagtgtgctcaggggcgttgccagctcattgctcttatagcctgtgagggaggaagaaagaaacatttgccagccaggctagtgacagaaatggattcgaaatatcagtgtgtgaagctgaatgatggtcacttcatgcctgtcctgggatttggcacctatgcgcctgcagaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacatgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccagaaaggaaagacaataattttgttttttcattttgaaaaaattaaatgctctctcctaaagattcttcacctaaaaaa

SEQ ID NO: 7 - DNA, 9004 bp, Homo sapiens
gccaaagcctggagaagtggaatctcgtcagcgccgctccctgcgcgggactcgcggaacggcactgagcatgctcagttgccggagcccgttctggtctcaagtaggaagctagtgcgctgtaaccgcatctgatctgggcgctccgggaagggcgagactggagcagagccgctgggcgccggagccgaggcgagcgccgcgcgcaccactggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcagatcgatctctttgggctgcctgacctccttgggtgcttgctattaattaacagactttgtggggaaaaaaaggagcttgccttctgagctttgtaccaaagacctgggaaaactaaccatctcagtctttcctgaggacttgggaactgccgaggcctctgccaatgtgttgactgtcgctatgggctcactgttgtccaggcagctcatatttcaaattataacctatttcctgcaccattgctgacgcctggtgatccatgtcagaagtacttccagctgactcaggtgttgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggagaactaagagcttcctaaattactatgcagatctggaaacctcagccagagaactagagcagaaccgaggcaatcaccatgggactgcggaagagaaatcccagccagtccagggccaggcctccaccatcattgggaatggcgatttgctgctgcagaaaccaaacagaccccagtccagccctgaagacggccaagtagccacagtgtcatccagcccagaaaccaagaaggatcatccgaaaacaggggccaaaaccgactgtgcactgcaccggatccagaacctggcaccgagcgatgaggagtccagctggacaacgttgtcccaagacagtgcctcacccagctccccggatgaaacagcagatatatggagtgatcactcatttcagactgatccagatttgccgcctggctggaaaagagtcagtgacattgccgggacctattattggcacatcccaacaggaacgactcagtgggaacggcccgtctccatcccagcagatctccagggttctaggaaagggtcacttagttctgtaacgccatctcccaccccagagaacgagaaacagccatggagtgattttgctgttctgaatgggggaaagattaatagtgacatttggaaggatttgcatgcagccactgttaacccggaccccagtttaaaagagtttgaaggagcaaccctacgctatgcatctttgaaactcagaaatgccccacaccctgatgatgatgattcttgtagtatcaacagtgacccagaagccaagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggggaaagacatgtacctgatcctggagaatgacatgctcagcctggtggaccccatggaccgcagcgtgctgcactcgcagcccatcgtcagcatccgcgtgtggggcgtgggccgcgacaatggccgggattttgcttatgtagcaagagataaagatacaagaattttgaaatgtcatgtatttcgatgtgacacaccagcaaaagccattgccacaagtctccacgagatctgctccaagattatggctgaacggaagaatgccaaagcgctggcctgcagctccttacaggaaagggccaatgtgaacctcgatgtccctttgcaagtagattttccaacaccaaagactgagctggtccagaagttccacgtgcagtacttgggcatgttacctgtagacaaaccagtcggaatggatattttgaacagtgccatagaaaatcttatgacctcatccaacaaggaggactggctgtcagtgaacatgaacgtggctgatgccactgtgactgtcatcagtgaaaagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatgttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggatgttggaaaaaaatgaaacttcaaaattgatgaaaaactaaattcgaggaattaaaatcgaacaaaacatagcctttcttttccgatggttttcaaactgattatttttaaaagagattaataaaatcataatgcattttgggtgggacatatttcaaacttctgccttatattgtacggtgcagctagagaattatagttcactatggccattctctacataaacattaagatgaaatactcctcatcagcctttcatccttagtttgagaattagctgatatgcaatttgaagttgaggaaatatcattgatatttctatcatgcacgattattttagatttctaccaccgtgtgatttttgctagtccatgtgctagaggtaaacgttctgctggaattctgcatccagctctatccccctctgatgctttttgcccagaaagctgtctgtccatcatgtattgtccatggcaacaaattacattaggttgaacctttccttgattttatgtatttaatattagaatttgttggactcaactagatatattttttaatttatattttttccattttactttgaagatttgaaatgttcatacctgagcaaagtctacacaggagtaatggactgtttaacaagtttcccaaaacagcattttcctgctccttcgtatgtaggtgagaaacttagctggaaagacatacaaatttagactctcgttgacattgtcgttttaaaaggaagttgctaaggcgatcaatctcaatattagtcttgtttacttcttcttaatgtcaaaattaacatttacaacatccaattataaaagtaatgctttatgtttatacactgctatgtacttgtcaaaatggtttccacattcttatcacatctgagccttaccaggtagagaaggtactaaatacactttagaagtaaaaatatgaagtaccgagaggctaaacccactggcctaagatctcaccaaagttcatgaaaaccaggactaggacccacggctcccaaagcccgttcttgctgtgttgtgctgcctccatatccgtcaggaagagcctttccagaatgattctgggcatatactaagaagagcaggtatggaaagatctattgtcagggaatcttagaattccctacacgagtgggagaaagatgtccaaattccttacgcagtggtattcatgatggtgccctatctaagtccaggactgttttcctacagcgtgcctcaaaagtgttgtagagggcaggattctacattcacagcctgttccatctacgagattttccagatgctacttgtggtagacattcctaactcatggtacttagccaccagagatcatgatggaatgagtgggtggcttttctacctgccattccctcagaattcatgaggggtgggggacagggggaccggaattgtcttagcaccccaatgttatgacaaaactatgctactttagaaacgcagtctgtttttcaccaattgacatactactgatctgaagtaaccagtgccatcataagaaattactgcattaagaaaatccttgctgtgccctttgaaaagctgttcagaaatcatttacagtgatctttcatctcggtcgctgtagtgaaacattttagtgtgataaatttcaaaattctaaacaaattacccacttttatattggaaatctctaccagaactccctcttcattttttaaggcatacatttgcttgttttcaagatcaagaattctgagctagctttaagtagcaaactgatttatatgtgcaattataggatgcattaagatgaatgatagcctttacatattgaaaactttgcagacgttttgttttgaaaatggcattgtatagtaaatgcaaattaattttgtaaaattatgttaaagagtatgttcagacactttctgccatggccaaaaagtatgtatgaaagtatgtgtgtatttgtttgtaaaaggatgccaatgttttacctgatatcttagtgacacttcagttatctatgcattctttagatctgtgattcggtaaacaggcagccatgttcacgatgccttctatgtcttaccatatttttaattaacctgttaaatacagcttaaaatatttttattttatttattctatttttactgaaatatactgcattattgtgttaatgtattatctttcctggatattatctcccagtgtatccagatctaagtaatctcagtgaactatacattgcctaaaaagtggttttgtaatgatttgtagtcacatttctattgggatatgtagaagaaaaggcaaaatgcttaaagttccttttattttttaaaagcagctagatagacacagacttgccacctcatacatctgctccttggcaacatcaaggggaacgactagccaacatgcctatggctaaaaactttcctttgcagactaaagcactgcttggtgcttcgtttttctacccttcacaacatgtgtgatttcatctaagagatatatacatgtacacatgccctttgtttccacctggatacaagatcactcatagctaattaggaccattgttttttgttcatctgtcttgttgcatgaagggacattagacccatttccattaaaataagttcttggtgataaactgtggcactgctacttctttttaaatccactttatgatttcaagatggacacttgtaagatgactcgacacaaggccattgcctggaagccccagagctttcctctgtttgtatggcccgttcatgtcccaggcattgcaacacaaactcctcaagatttcaccacaacatgacaagcattttcctaactgatattagcacaatttaactaataagccccttcgctctctagttggccaggcttaacctaatacacatctaacgtgtgtgccacacggccagtagaaagtttaacttcagcttcagggcaaagatacccactcacaccgtgtcaacgcaagcagtagttcctggcctccagagcagcttacttcccctgaaagaacgctttgttttcctttatgcccttttcctgttgaccacttttacacatttaaatgtaatttgttgtgagaataaatttagctgcataaaacgttcggctcatttatctgacatcttagtcacatatacaaggaatagaaatagaaactcggtgtctctagttatttttaaattattcttacctcagacttcttagaaatcactttagtaatggagcattttgctttgattagttactacatatttctgcctggtaagaactaggaagtaacttcaaattttgagtaatcaccctgtacttatttggtgatcaggaaggccagctggccttccggacatagaagcctatttagtcaccaactcgagtcttttgtaagcggtcttgctaggattgtgatattttagcacgaagaagtttatcacttcctttaagaacctgacatcaaagaataaagaatagaggtgtacacacactaaatccaaaatgaaaggtaactagagaaatcagttgaatctggtttagcttaactgttaggcgcaggaaggcagataaacagaatttaaagtatgtccccgctttttgttcatcttgcacttccacagtggtttctctctagtcagtaacaaaatttcattatggtttcaggcattatatggtggtaaataatttcagattaaaaatgtgtttgctattggagtatctgaatactagtaatttcattatttagaattttgcagcacttttatctcaagaagaagtccaagaatgtaaaatgccaaatgaaacatgtcagtggaatcaatattctccttcattagaattccctcatattgctttttttttttttcttcagacagaggagtcttactctggagtgcagtggtgtaatttcagctcaccacaacctccacctcccaagttcaagcaattctcgcctcagcctcctgagtagctgggattacaggcatgcaccgccacgcctggccaatttgtatatttttagtagagacagggtttcgccacgttggccaggctggtctcgaactcctgacctcaggtgatccgcccgccccaacctcccaaagtatgtgagccaccacgtccggcctcatattgcttttatccaaaattcttttcccttttcactctaccaaagtatttaaataatcctgtccttcatagaagattctcaaagaagaaaactgcagtgtaattaatgaatggtttaattcagaatcttcatatacttctaaagagaaaaataatttagtgccaaatgcatgttaggagataatcaatgtaagtggcaacaaattgtgacttcacatgctactgtagagatcagaaaattatcctaaactattccataacaatgagacaacatcacagaaaatacacttgaaaataaaaatctcaagaccagctacttctggacaatggaatacttttcagtctggtatggtggagggcccgaaaaggataagggattcttatgatacacaatgggattctttactgaacaatatgttaaattaagctgcaccgccttccttgaggcatggactaccctaaccaaccagatagaaatctgggtgggataagaggatgagccacacgctataattttagggcaaggagatagtgtttgattttcaaaatcagcaaaataagctgagcactttatatctttctgtacaagagtgataacatgaagaattcttcttcagggatttaaaatacaataagcctggttcaactataaaaagtcttgtttcctttcttcattgacacttttttttttttttttttttttttgaggcaaggtctcactctgcttcccaggctggagtgcagtggggcaatattggctcactgcaacctgcacctcctggactcaagagatcctcgtacctcagcctcctaagtagctgggactacaggcgtgtcccaccacacccagctaatttttgtattttttgtagagatggggttttggggtttcgccatgttgtccaggctcgtctggaactccggtgctcaagtggcgtgcccacctcagcctcccaaactgctgagattacagatgtgagccactgcacccagcccactgacacgttttactgataaatgtaaatctaagctaaaataaaaataatgtattaccgctataatacaattcaccattctcttttctcacttcaagtaagaaagtaaaaatagaatatcagagctgaagtagacctaagtattcatcttgaagaagataatattctaaaaatcatgccacctgaattgagcatttaggaatttatgtaacatttctatacaactgaattgcaaaaataaaactttaaattcaaactttaaaaaaaaaaaaaaaaaaaaaaaaaaaaaa

SEQ ID NO: 8 - DNA, 2444 bp, Homo sapiens
agcaggagggtgggaccaagggtgctgctggaccaaggatgggactgggccaagggtggggctgggaagcatcctgttttgcatgtttgatcaggagctgctgccaagttgtgactttcactttcccttttgggttccagggtatatctcagagcctggagaacgtgtctggttattatgcagatgcacggctggaggtgggatccacacagctcagaacagctggatcttgctcacactctttcaagagaagcttccttggacaaaaggaccctgccttggtgtgagagtgagggcagagggagctggagcaagtagaatttctctaaataccagctggctggggcccaggagattaaaaaacaccgggctaggttggtcttggcatttgctgacacgcaaagggattgcagagatccagcccctccaacctccctctgtccacaggtggctcacattcagtcccacaatttgctttctcctcctcaagggttaagaaaaaaaacgaacccttccagtcaggtcagtgactggagagctccatggaaagtctctcagtgacctggctgctggcaccatggactcagaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaatgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaa

SEQ ID NO: 9 - DNA, 1882 bp, Homo sapiens
agcgctcctataaagggagccaccagcgctggaggccgctgctcgctgcgccaccgcctcccgccacccctgcccgcccgacagcgccgccgcctgccccgccatgggtcgacagaaggagctggtgtcccgctgcggggagatgctccacatccgctaccggctgctccgacaggcgctggccgagtgcctggggaccctcatcctggtgatgtttggctgtggctccgtggcccaggttgtgctcagccggggcacccacggtggtttcctcaccatcaacctggcctttggctttgctgtcactctgggcatcctcatcgctggccaggtctctggggcccacctgaaccctgccgtgacctttgccatgtgcttcctggctcgtgagccctggatcaagctgcccatctacaccctggcacagacgctgggagccttcttgggtgctggaatagtttttgggctgtattatgatgcaatctggcacttcgccgacaaccagctttttgtttcgggccccaatggcacagccggcatctttgctacctacccctctggacacttggatatgatcaatggcttctttgaccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcccagatattcagggcaagggaccagtcggaagggattctggctattgggggagcccagagacaggggaaggcagcctgtccatctgtgcataaggagaggaaagttccagggtgtgtatgtttcaggggcttcacatggaggagctgcagatagatatgtgtttctgtgtatgtgtatgtctgcctttttttctaagtgggggcttctacaggcttttgggaagtagggtggatgtgggtagggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaacctccaaaaaaaaaaaa

SEQ ID NO: 10 - DNA, 7599 bp, Homo sapiens
aggcaatgagttctttccctgtaagttgggcacaaaaagatcggcatgggagcagcctcctttgagacagctgctctgagagaatgcaataagcagggagcagccagcaattcctcctagcagagggcgactcgtgggaggagttcagtttgccaagtattgtcatttgttgagagaaggtgtgtgctcaaggaggagttttaacctggaggatcattaactcttttagtcagctgaggagctgcggtggctcggcgagttggagttcatcctggaagcgtctgcacgacaaggtcagggaggaggtgtggaataactttttcatgggacactttgagaagggccagcacgctctgctcaatgaaggagaagagaatgagatggagatatttggctatcggactcaaggctgccggaaaagtctctgccttgccggatccatcttctcatttggaatcctccccttggtgttttactggagaccagcatggcacgtatgggcacattgtgtcccatgttccttgcaagaagcagacactgtgttgctgaggacaacggatgaattccaaatttactcttggaaaaaggtaatatggatctacctgtcagcattaaacagcgcatttggtctcactcctgaccaccctctcatgacagatgaggagtatatcataaatagagccataagaaagccagacctaaaggtgagatgcatcaaagtgcagaaaataagatatgtttggaactacttagaaggacagttccagaaaattggttctttggaagactggcttagttctgccaagatacatcaaaaatttggatcaggcttgacaagagaagaacaggagattaggaggttaatatgtgggcctaatactatcgatgttgaagttacaccaatttggaaactgctcatcaaggaggttctaaatccattttatatatttcaactcttcagtgtctgtttgtggtttagtgaagactataaggaatatgcttttgccatcataatcatgtccataatttccatatctttgacagtatatgatctcagagagcaatctgtaaaactccaccatctcgtcgagtcacataatagcattacggtctctgtatgtgggagaaaagctggagttcaagagctggaatcacgcgtcctggtgcctggagatttattaattttgacagggaacaaagtgctaatgccatgtgatgccgttctgattgaaggcagctgtgtggtggatgaaggcatgctgacaggagaaagtattccagtcaccaaaactccgttacccaagatggatagctctgtgccctggaaaacacagagtgaagcggattacaagcggcatgtcctcttctgtggaacagaggttatccaggccaaggcagcttgctctgggaccgtgagagccgtggtactgcagactggattcaacactgcaaagggagaccttgtgagatccattctctaccctaagccagtgaattttcagttgtacagggatgccatcaggttcctcctgtgccttgtaggaacagccaccattgggatgatctatactctgtgtgtctatgtgcttagtggggaacctccagaggaggtggtgaggaaagcccttgacgtcatcacaattgcggttcctccggctctacctgctgctctgaccacaggcattatctatgcccagaggaggctgaagaagagaggcatcttctgcattagcccccagaggatcaacgtatgtggacagttaaaccttgtctgctttgacaagacaggcaccttaacaagggacggcttggacctctggggagtcgtgtcctgtgataggaatggctttcaggaagttcacagctttgcctcaggccaggctttgccatggggcccactgtgtgcagcgatggccagctgccactctctgatccttcttgatgggaccatccagggagaccctctggacctcaaaatgtttgaagccaccacctgggaaatggctttttctggggacgatttccacatcaagggagtgccggcacatgccatggtagttaagccctgcagaacagccagccaggtcccagtggaaggaattgcaatcctgcatcagttcccattctcatcggcactgcaaagaatgacagtcattgtccaagagatgggaggtgaccgactggcattcatgaaaggtgcaccagagagggtggccagcttttgccaacctgagacagtacccactagttttgttagcgaacttcagatttacacgacacagggcttccgagtcatagcactggcctacaagaagctggaaaatgaccatcacgctactaccttgacgagggagacggtagaatcagacctgatatttctggggctgctgatcttggagaatcgattgaaggaagagacaaaacctgtcttggaagagctcatctcagcccggataaggactgtaatgatcacaggtgacaatcttcagactgcaataacagtggccagaaaatctggaatggtttctgaaagccagaaagtcattctcattgaggcaaatgaaaccaccgggtcctcatcagcatctatatcttggacgttagtagaagagaagaaacacattatgtatgggaatcaggacaattacattaacatcagggatgaagtctctgataaaggcagagaaggaagttaccattttgccctaactggaaaatcctttcatgttataagtcaacatttcagcagcctactgccaaagatattgatcaatgggaccatctttgcaagaatgtctcctgggcagaagtccagtctggtggaagaatttcagaaactggattactttgtaggtatgtgtggtgatggagccaatgactgtggggctctgaaaatggctcatgtgggcatctcattatcagagcaggaggcatctgtggcctcacctttcacttccaaaactccaaacattgagtgcgtacctcaccttatcaaggaaggacgtgcagctctcgttacctccttttgcatgtttaagtacatggctctgtacagcatgattcagtatgttggtgttctgctgctctactgggagacaaacagcctttcaaattaccagtttctgttccaggatctggccattacaactcttattggtgtaacaatgaatctgaatggtgcctaccctaagctggtgcctttcagacctgcaggacggctgatctctccacctctgctactctctgtgattttcaacattcttctcagcctggccatgcatattgcaggcttcatcctggttcagaggcagccttggtattccgtggagatacacagtgcctgcacagtacaaaatgaaagcatctcagagttaaccatgtctccaactgctccagaaaaaatggaaagtaatagcaccttcacaagttttgagaacactacagtctggttcttgggaacaatcaactgtatcactgtggctcttgtgttctctaaaggaaaaccatttagacagccaacttatacaaactatatatttgtccttgtgctgataatacagcttggtgtatgtctattcattctatttgctgatataccagaattatatagacgtttggatctgctctgcactcccgtcctgtggagggcctccattgtcatcatgctcagcttgaatttcattgtgtcccttgtggccgaggaggctgttattgaaaatcgagccctgtggatgatgattaaaagatgtttcggctatcagtcaaaaagccagtatcggatatggcagagggacttggcaaatgaccctagttggcccccgctaaaccaaacctcccactctgacatgccggagtgtggcagaggagtgtcttacagcaatccagtatttgagagcaatgaagaacaactctgaaggacatgtgatatccaagttgatattacagagaaacaatgacaaaagggaccagtttcattgattttaagaaatgagactcttgtaacatcagctggagttttggggctacctatcaaatcatggtgacaaactaaagtctgtttgataaaatactgtctacagagaagaacattgacccagaagagtgctttcctcttggcttctgaaggtattagaggcattcagtgaaggcaagaatgggccaagaatttctatgggccaagagacaagcaggctaaaggggaaaaatatgtgatctttcctcttaggacaggacaatactttcctttttataaaaatgagttgaggggaagtagtactgtgtatactcacggagttgtaatttttgaatttttacttcatcgatggaaaaactaatgcgtgggaaacattacaccaatctttactgtctgggttccttttctctgtagtacttttcagatttgaggctttttcttctgtttctggccttacccaacatattgttaaggataagcttagcctatgctgcaataaaaaacaactctcagatatcagtgccttaacacacaagtgcttctttcgtgatccaggtgacactctggaactgccattcttacagcagtgactgcttcaacctgatggctccatcagctcgatgcaaggactgtgtgttgactgtgatgggggaaggaatagactggagatcacgtgtgggctcttcactgcctcaccccaaaagtggcacacattgctttccctactcatatctcattagtcaaggatttggccagggagctggaaagtgcagtctcctgtgtttagggatgcttcatgggcttatgagctgtcactacacagggccccatgcttagaaggtccccacacttggctttaacactctgctgtttccatcttaaaattcttaatttttgaacaggggtccccatattttcattttgtaccaggccccacaaatgatagagttggtctggaacgtagtcctgggaaggagaggaaaataacagatcagaaagcacgagtgctgtccactacagcccacttttcctaaccccagtaacttatcctatgttttaggaatctctcatgtcacatggccaactccagaaattttcactcctctgctttattatttttgagaaacattagtctcatgctacagcattatatggcactattgatgggagttcttacacaactagtacattttttttttaaagtttgtggcttgagtttccagaaaactaaaattgtccttattttgtcactattacaatttggttatatttgatttgttcagcacaaggaagactcaggtttctgttacctcaggagacaacactgaactctaggagcacacctacatataatattttaaggcaaaagcaaaatttgtattatgagcatcaaatcctaggtgaatgttctgatcaggggataagtgtcctggcccaggctggctttggaacttatcaatagcatttgcaagcattccttccccctaactgagctcttgagcatggctgatggctctatgattgcagctgattctaggaacatggtgtctcccagccatgagggtaccctgttacttctggttttaaaatagggcgtgaagatattttagtgtttcaagactgcagaatcactgtcttttttggtacagaaagaaatgtttccttttgcaaagccagcctcagcaatgatatggcagttctgaatgtccttctctaaaagtgtttctcattttccaaaagtagagggttgtaggcaggggcaagctagagatggtctgtgacctagtcatgagcaagatcagcctgcacagttcatacttaaatgtgccctttgctaagtgcattcacctccactaactcacctgaatggtaccaattgtcccatgactgaacaaggaagggcttatcatctccaccatacagatgagaaagctgagattcagtaatggcaagagcagatctaggcctcaaatacagatcttctgagcaaaccttatattgctgccaaatacttccaaattccagagttccagcagggcaggttgcttagtgtgatctcacagtcaagcaaagaatgggcaaccctttgctaataccaggccctctgttcaaatgaatgccaggcatcctgccaggcctgggctagaggtgtattaaaaacaaaacaaaacaaaacaaaaaaatgattgtctgtctttctgagactttgagttgctcttgccttgatcctaagtgattctatcactagcaaaggctggcagggaacaggaagaaaagaatctagtcctccactagtcaagcagccataaaatctttgggaaaagagactcattttgaagactgtattcctgggattaactacatcttagaagcagtaattgaaggaacagggagtgcccagcctggaaagaaaacagtcaggggactgtgaagggttttcctgagaaagaaggatcctacttgtgccaggtggcatgagaaggcaaaatcaggacaaatgggtaaagatcacagtggggatggcttcaggccatctgccctaaccactgtcctaacagccagcactgatagcagtggaatgtactctaggacattggaggaacaagtggctattcaagggccaagtagagaaggaagtcaagtatcagatgaaactcaattacctgcaagatctctttcaagcttgatacacccagtgtctcagtcttatgctgtgatgtgaaccttttttttttttttttttttttgagatggagtctcactctgttgcccaggctagagtgcagtggcacaatctcggctcactgccagctccgcctcccggattcacaccattctcctgcctcagcctcccaagtagctgggactacaggtctgccaccatgcccggctaattttttgtatttttagtagagatggggtttcatcatgttagccagggtggtttcaatctcctgacctcgtgatccgcccgcctcggcctcccaaagtgccgggattacagacatgagccaccagatgtgaactattttctactactacccacacagaataccagacagacactcatgggaggatgggctctggagggagggctcccagccttgtcagatccgattgtgtggacatatagactcaattgccctgtaccttgaaaggggacccctaatggagataagatcctaggaaagaggggcagagtaggggtcctgattgtcagattgaagctggggtaatacttctgatttgtgaattttcttaaagagaggtgttaaaaaactttgcatgaaagagcgtgggagagtgccctaaacttgagggcggagcaacctgttatcaatacactttcttgagcagagtctgaaggagaaacgaacacagtcacatagtccaaatcatttgagacggtgccctgtatgttcatctcaaggcatctagctcttacccacagagaaccgtgactctgggcttccctcactaaatatgtctgtgacatctgtatccttatgtgcttatggaaatgttcacatacacacctgcagatgtgatgactgaaaaaaacgattatttattcagagctttgtatttagtttatgctataataaattcagttgttataaaaatca

SEQ ID NO: 11 - DNA, 1823 bp, Homo sapiens
attgcgcagccgcagggaagctggatggggaggggttgggaggcgaaccggaattgaggggtggttccgcggtgcgcgcgcctcgacatccgggcaacgcctctgttctgtcctcccccttcgtcgcctgtgacaaccggaagcggaagtgaaaatgggtgtccctgctgcctcttagcaacaagaggggtcaagtgacacaaccagctgactcccgtagaggaagacactgtggaggccagttctggagctattgcagcctcggttgcccggccggggacccgagccgaaaagttatcgtcagaatgtcgggcaaagaccgaattgaaatctttccctcgcgaatggcacagaccatcatgaaggctcgtttaaagggagcacagacaggtcgaaacctcctgaagaaaaaatctgatgccttaactcttcgatttcgacagatcctaaagaagataatagagactaaaatgttgatgggcgaagtgatgagagaagctgccttttcactagctgaagccaagttcacagcaggtgacttcagcactacagttatccaaaatgtcaataaagcgcaagtgaagattcgagcgaagaaagataatgtagcaggtgttactttgccagtatttgaacattaccatgaaggaactgacagttatgaactgactggtttagccagaggtggggaacagttggctaaattaaagaggaattatgccaaagcagtggaactactggtggaactagcttctctgcagacttcttttgttactttggatgaagctattaagataaccaacaggcgtgtaaatgccattgaacatgtcatcattccccggattgaacgtactcttgcttatatcatcacagagctggatgagagagagcgagaagagttctataggttaaagaaaatacaagagaagaaaaagattctaaaggaaaaatctgagaaggacttggagcaaaggagagcagctggagaggtgttggagcctgctaatcttctggctgaagagaaggacgaggatcttctatttgaataatctttcctgttctggttctttgagaaaccctaacactggcttcattttaattcacagtgtgtaggtttgatttgtgtggctatttattttttggcctaagaatttcactggttgtaaaatttacctagatgtctatttatgggattacttttgcagaatcataatttagcaaccatttatcatggatgaaagagatctgtaaaacctgcccaggaacttacagaatttactttgcagaagcgttatcatactccatttacatctgtgttacacgtgatctgcttaccaagcatattaggaaatacctcttaggaagcattagcggtctcaggccaattactgtggagcagctttcattcctacccacttgcaaaccttggcgctgttgtctgagattgctgcagccattcttgttaccatggtacttctcaaactttgtgaaaacctgcacttttccttgcatgacaggttcctgtcttgtctgtcatgggagccattctgccaatttaaatgcgactgtggtataaacagtaaaatgatttaaaagtaagtcattccgtttttattaatttactgttaagtcatgttctcatgctcagatcagtagtgtcagccagagctttctctgcagacatgtaggaagtgggtagctatttttcccactccatgtattagagttttacaaaaaggcttacttttgagacaactgttgcattttggggtactaataaatgattgccgatgagttatgagggcaaaaaaaaaaaaaaaaaa

SEQ ID NO: 12 - DNA, 2287 bp, Homo sapiens
gcggtgccagcccaggccccgcccctgggagggcgcttccggcacagcggaactccgggtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcgtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacagattcttctttactgccaaccaggtaaagatttacaccaatcaagagaaaaccaggacctttattgggcttgaggtcacttcagggcatgcccagttcctggacctggtttcagaggtggacagagtcatggaggaattcaacctcaccactttctaccaggatccttctttccacctcagcctggcctggtgtgtgggtgatgcacgtctccagctggaggggcagtgcctgcaggaactacaggcaatcgtggatgggtttgaagatgctgaggtgctgctgcgcgtgcacactgagcaagtccgctgcaagtctgggaacaagttcttctcgatgcctttgaagtgagcaccagaggccttcctcctccagggccctctgcagaccaggctgagatggaggaacctgctaaaatcgatggagatgcttctagcctcccagtaggaggccccagccatgccttcaacctggcaggaggtgtagccactcctcatcctccctgagtgctgatattctctctctctctttctcttcctcttctttctctctcttctcctctctttctctcctctgtctctcttcctctcctctcttcctctcttctctcttcctctcctctctctcttcctcttctctctcttcccctcctgtctctcctcccctcctctcttcctctcctctctcttcctctcctctctctacccctcctgtctctcctcccctcctctctcttcctctcctctctctcttcctctcctctctcttcccttcctgtctctcttcccctcctctctctcttcctgtcctctatctcttcccctcctctatctcttcctctcctctctctcttcctctcctctctctctcttgctttcttctctctctcctgtctcggctgttgtgggttgcaggttgggtgctgctgttgtggtccttcccagaaactgccagtagagggcagcctgggcatcctaatgcttactctggttgttacacaaagaaaatattggggtcactggcgagcccacccacactcaccagaatctccactgtagtccccctaacaaacagcccttcacttcctctcccacttcagcaatttgtattttgatgccattggcctcagatcagagtgttttaaatcatcacgccctggcttatccctggtcgagccaggacacggggtgcttcagtgggtctgtcaccctctctccttgaagcatgttgcttttatttatttacttttactctcaccctgctcctgtaccagcaggggccacttcaaagccaaggtacagggtgataacttgtggtccagcatcagttttctccacttctttctcccactcacccccagcaaggtgcctggggagacttgagcagatgtttcattttggcctggccagtggctgaaagccaggcctccaatgcactgtgacctctggcttccccagcagctttcccagagaggcagaggggccttccacagcccgggttctcctgctgcctcctgcctgctgcagctgcaggcattctgaggggcaacgtggaggaagggccagggatgcatgggattttaattgtttcatcacaccttccccgtggcaaagaaacagtcagtcctcttcaggtgtcttctggatttctggtgatggacagagaaatctttttacagtttcaaattatgttcaacaaataaaaattgcattttttattttggatcttt

SEQ ID NO: 13 - DNA, 11516 bp, Homo sapiens
cacaaagagcggggcggagaggcagctgcggggggagccggcggccgctgctgccgcccagggctctggggccccgccggccaggcccgccgtccgcggccagtgcccttcctcctcctcctcctctgccgccgcctcctcagtcgccgccgcctcctcagtcgccgccgcccgcgccgcccgcgccctccgcgcgcctctgagcccgcgccgggccgcgccggccccttcccatgcgggcggcgcgggccctgggaggggcgcccggagccagccgcgcagcatgcactggggggttggctttgcttcgtccaggccgtgcgtggtggatctgagctggaaccagagcatctccttcttcggctggtgggccgggtccgaggagcccttctccttttatggggacatcatcgctttccctttgcaggattacggtgggatcatggcagggctgggctccgatccctggtggaagaaaaccctttacttgaccgggggagctttgctggccgcagctgcgtatctgctccacgaactcctggtcattaggaaacagcaagagattgactctaaagatgctattattttgcatcagtttgcaagacctaacaatggtgttccaagtttatctcctttctgtttaaagatggaaacttatttaaggatggctgacttaccgtatcagaactattttggtggaaaactctctgctcaagggaaaatgccttggattgaatataatcatgaaaaagtttctggcacagaattcataattgactttctggaagagaagcttggagtgaatttaaacaaaaaccttggccctcatgaaagagccatctccagagcggtgaccaagatggtggaggagcacttctactggacattagcttattgccagtgggtggacaatctcaatgagacccggaagatgctctctcttagtggtggtggtcccttcagcaacctgctgaggtgggttgtgtgccacataacgaaaggaattgtgaaacgcgagatgcacggccacggcattggccgcttctccgaggaagagatttacatgctgatggagaaggacatgcggtctttagcagggcttttgggtgataagaagtacatcatggggcccaagctttccactcttgacgccactgtctttggacacttggcacaggcaatgtggaccttaccagggacaagacccgaacggctgatcaaaggtgagctgatcaaccttgccatgtactgtgagaggataaggaggaaattttggccagagtggcaccacgatgatgacaataccatctatgagtctgaggagagcagcgaaggcagcaaaacccacaccccgctgctggattttagcttttactcaaggacagagacctttgaagatgagggagcagaaaacagtttttccagaaccccagacacagattttactggacactcactctttgattcggatgtggacatggatgactatacagaccacgaacagtgcaagtgacgtccagcctcactgaccctcttccttgggacctgccactccctgggtcggtccattttcccaggtagcaatccatccgagctgggaggagatcttcgtgcttggcagagttttcacatgctaactggactatagcagccttatttcttttttgtacaaacaaaacacagaaccattcagatgactccattgaaaacaaacaggcaaaaaataatgtcagcatggttcctgaaatccatttttgttttcattagaaaactattaataatattgtgtggtagagcaggtgtaagagctggttgtcagctgatagtttttatgatgatcctcttcaaccctgaggtcttaattgtgagatggattcttgaacctccttcctccaccaggatttgaagtaatgagagatatcatcagaaaaatgttttacggtggctgcttgtactttatgtgtgtatattgtatgttgagacataagtcaaataaaatccacagatattaaacgaacacctactatgtgcaaagcactgtgctaggtgctaatcagtatacattttattctaagccctgccagtgactagctgtgtgattttgagcaaatctcttattaactattgggtgcctcatttctcccacctgtaaagtggggatgacaatactctccacctacctacctcacaggggtgttgtggggattcatgtggtaacattcgtacggcgctttaaacctcttagaagtggtgcgacataaacacagcattttattctttattgcacttcatgcatgtgaagatttgagggcaaaggaattccatatccaggcaaccaccaccacagtcacctgcaaaagctgagcagatgaaatacacacaaaggtacacttaggactttgtcatgattcctttctgtaatcttggctgaatcaaaatcttttgttcaaagaacattggaaatgtttttacaaattatcgacagctacaaacagtcttcaattctaccatgtatttgcagaaaagtggttctttcattgcctgaactcaccctggcatgttctgtgttgactccagagtgttacgttgcctatgtttgatttatttgagaagaataaatctcaggtatatggcaggtttcatagagttgaagggaaagtatttcattgatttttataagcagaagcctgccaacttgtaatgtctttttgaaaacaaaccttgcaaagatgtattgaaaagatgaagtagcaagaggatacttgtatcaaagcactctgtgcagtgttagactatatgcagttttattaatgcaacttttctggtgttttcagccactgcccagtgagaggagagcaatgctgagaacaagtcttaatgtttttgctgtctcatccccgttctctctctctttccctatagtattcgatgaactgttggcttacccatatttgtgaaggcaccctatttctaaagatgaagttgttgttgttgttgttgttttgacttaggacattttccagggaaatatggggcagagatcctgggtgatggctgtgagatttgggctaggagagccaagatttacaattgcaaacaaaactgctttgcttctgaccaacataaggattgctcattatggggttaaagaggcacttcttaaaatacagcaacttctgagaaatccatgcactttacttgaaaaaaaaaaaacctctttttgaatatagcatttgcaaaacaatcttaaaagactgctgtagattcacaaagaggtaaagggaggagagtttttcagactgcttaccacttaagcaattgtgtagggcatatgtaactgggaatacgtgctgagataccctaagttagaaattcttattccatgggaaacttagttgttaatatcttattaaaaccattcttatttaaagggactgtttgatgcctaataagaatgtggtggagaagatatgaatggataagcctgtttgaggctgcagcatcatttgggaggactgtttgcctcccctctctctagcaagtgtgttttaaggccaactggtggcatttctgtgtgactagggagactcctggactgaaaatatgaatataatgaacaggtggactgcagacctgtctccacaaagcatgggttgtccttttcccaccacattttagtagaaaagaaatgtatttgaatttttttctatgaacaatctatcttactgtacagtaccaagtgtgatgtattttctctcaaaggatgattaagttatgagaatgtagattaatatatgtttttaattttatattacttggaatacaagtatgtggagaaccaactttgaaaatgaagttgtaaaataagtcattccatccaggtacctcttacaggggcatgaatggacattgctatctggagtcttgggcaattgcctgacagcatataactgggcatcaacattttgtaggtgttaatttgatttagagccctagaatatgcccctgctttactttcccaaggcgggttatgcaaacaaaataaccaagacaaagtcaccatagtgtgagtctttatccggaaggatttaattttatgtgcttcattcttaagctacccagatttgaaatgttctccaatttcatgaacaggtgctaattataggaaaaaactataagaagttaagggacattttggtcatctggcttcttgttcaagttctgtgtttcctttttgctggaaggtaacttgaagtatgtgatctttaatgttaacagatgcttttggttggacaacagacccataggctattcgttctttttttcctgtcattgtaaaagtaaatcaagctcttgcatccacctctctttgcccatctgtacccccactcaacaagattaatgagcagaatcattgagctttactctccatcagaacagatataaggacaatctatatttatgcaatgatgaactatattgtcagcatttaccaatttgttgttgttacataatgaattgtagaaagtgacactaccaaggctgtgggctacccaggagactaatcacggacctggaacaacttggacttgaatcagactgcagtctactcctcaagtgagccctgcccatgtatactgtggtgttagggtatatttttgtgaaatagctaaggttcaaggaacagacatactaaggattttggccttgtgggtcttgcttagatttgtttgagagataatgtagagtcatagaaatgtatagctgtgctaaaaattagctgtagaaagcaccttattggctcagtgtcacatacatacttatttgaagggcaggaccaaaaactgaggtcaatatggttctttccattacaccacgttgcccttgatggtttctttctattataccaccttgcccttgatggttctttccattataccactgtggctttgttgtcttataaaatgcatgttacctgagaagtcaccctgtgttcagacaaccagcacatctccagccattccctggttggaatcctacttcgcttttgtccatgtcctgtcagcctggtcaagaccaatacaagagacctctcatcagtgcagggtattgctagactctgaagaatagcaagatggattcccaaatcaccaagactcctcatacttccttatgtatcttttaaagaacccatgtccattccctcacttgctgaatatttacagagcacctaccctgtgcctggccctgggatctacactggttgtagagtggcaaatagaacagcatagaactctgatttcagggcatcctcttttgcctagacttctctagcctcttttacgtacttggccatttccctgttccattccatccactacaaatggattaatctttctaaaaagctctttggccctgatggggtgtggcattgcctcagggtgaggggctactccttagggtctggtgttttcacctttgttcaccttgtctccatagctcctccatgggagccatccagtgcagccaggttgatccatttgccattgcctaaaaaagcctcatgtggcccacctctgtgcctctgctcatgccagtccttctcctgaaatgttctattctctgctccactggcccaagtcatgcccatctctcaaggtctgacttcgtcagcttcacatgaaggcttcccagctgattataatctcttcctttgaaaatgaagcactcatcacttccttccctgaaggttgcatgggaaagatgctcagagagtgagtcacataccattaaatagtgaattttcactttttgtttgtcaggaactccactgataatccaacgaaagttctataccctattcccagaaaaacacatatatgcaaatacataaaatgttacatataaattcaggaaatttagagacctcctgaaattatccatggtttcctcagggggttaatggaccccagttaaagagtcttgttcccaagagtctttaaatgttatcattgtgtttgttcttgtttttaacacagccagagagaagaaaaattagtacaggctatgcaagcaaaagtaatctctattatccatgttcagtatgtcttgagtgacagaaaagaagaaagaagtgctcttaggttatttgagaaaattttgttttagaggtttggaattttgaaagtcataggattttgttgttgtccttgtcatttatcttttaaccacccccaaaattgatttatcaaaatgagttcagggccaagtgcgcttcctttcagccctgaaacccaccgcttctgcatggatagggcaaccagcctgggctgaaggtgggagagaagaggctggatttttcttccttaaagaagaaaggtctgcacaatcaggttttcctgtattcatttattcattcattcatagaacaattgttgagtgtattttcaataaaaggttggtggcttttgttgatagggaacaactcaggttattcttctttctttcttttagggttttttttttttttaaacagagtatgttattttattgttcctgactatgacccaggatcctttgttctcctttatatgcagtgctatttaagtcaaactagaactgataaaagtacactcaatgacgaatacttcccaggctaaatgctgggctctgggaacccatctttaacaggtccagggatcaattgcatgtgattgtgaagtgcttgacctttattcagttgcttccagtggtctggatataacttgggaagttcaaaaggattcccttgttgggtgaggagggacgggcctcttacctgtaagactcttgctactgtcaggcgtggatgcgaacatctgtggcatgttttcctcatctgaattccttacccagaaactcagatttttggtccctgactttcaagaatatcttaaggatatttaagtttccttaatctttgagatgagactgctggaaccagcaacgttagccttgccagttagagatgattacagagggcactgaagcatagatttaaaaaaaaggggttcagctgttttggagctgacagggtgacctcctcaaccattctgctttcgccgaagcaaggaacttgtccccagacctagaccctctaaaactcctgctattggctggaccatgacaaactaggatgctcaaatttcataaggatgattgccttaaattgtaaaattggtagacaaataaaggggaccattgcaataataaaacgaataacctacagatatggtctagcagcaccaaactgaccatttcagtaggaaaacaagtaatctggagtaaaagatggatacggtactttggtgttctgtacacaataattttagcaaagaatttaatggccatcatgcatttttgaaacaatccactaaccataaagcaatatatgtgtatcataatcagttaactttataaaaagttgtgctactaaatgtgactaattcacctcccaccccccattggcatgcatttatttttatttatttgtttttatttgtggctctggaatagagtaactttcacttattagtaatgcttaagcttttttccttatttaataccttttttgtttttagttaccccatggcttctaaaaaaataagatccaacttctgaattgccatgttagttaatggtggctaaacagatagcaaagggaatataatataattgttcattgagggctaaaaaagaggaatgctctgaatatttactgtcttcctcctctttaaaaaataatcaatgactttcctcttccattgttcagaatcagaaatgttctttcgtatttgcttctcttctacaagagattatatttggcttattaaaatataaaccatgtccaaatgattgtatttttatctttaacaaattatgcctgggatttgttttttacagaaataaggctaaaggcttctgcttcagtaggggtgacatgtttactcctgtaaaatgattttaatgttactcctgtcaaaatgattttattgcaagtaataagtcttgtgggatcagaacaagcttattgtaaacacatgtttttttcccagtgatctacatcatgccaaatgtctgacaactcaaatgttgatgacagcgatggtttttccatggtgaagtttggaaaactgagggtctgagtccctcatttggtggtattagaatttaactgagtaggaggagagaagaaaacagtaacaaatgtcaaaatttcaagcaaccatgtggtatggctgtggtagagatgtatcaggcaattgaaagttttctaggtggtgccatcttgctaaaataataaaaagtacaggtttataaatcaaaaacaagtgcaatctatgtagggaaggattgtctatggatatacaagtggccagtgcaggaagtgaagtaacatttatctttatcttaatttctatgctcatgtcccccattccccttctgaagccaggcctgggaccttagatagcagcttagagggtctggccctgatacatttactcctttaattttggaatttccttctagtctctcaagagtgtttgtggcatatatttttcattttataaatataaaattgtacaaagtaatgtacattttgttttagagaagtcttttaaatgtttgcagacagcccagatcgtccatccctatttaggcagtggtctccaaacgtttatgtttattcaccctattagtaaaactttctgagcatgcccctccatgtatttatttatgatatatatgtatatatgtatacactgctatatatgtatatactgttttactgatgtaaacattaaaaaccatagcaaacatagacattttaaaagtatattttctggtcctcaatggagtttagagaatgggacaaggagtctttaggcgtagcacccagatgcctgtaattgattagagaatgtgtatataccatttgtggcaaagcagatataaaacaggcatggacgcatgattttaggtcaaggtatttaattatttttacttaaaataggcatttttggttgggaaagagaaggatgaacaatttgatgtcacctttaagactgatgtttttaattctgcttttgggaccacttgatctagaatgccttgaaaattccagaaagatttaacaacacactgaggtaagcaaaacaagaaaagaaagtaggggtgaggtgatacccagataatgcaaatgcaggatgtattgtctgtgaatttcagcatcaatctgaaaaacatgttttgataatgcctgataattcatcatctcactgattacatgtctttttttctatttgtttataatcttgtgtcttcaaatgtgtggaagatgtgcagacttatttttaggtatctgagataggaagggccaatgttggcataatttgaacccacatttcggggctaatgggcggacaccacctggaaacacttacctgcaccctctgttttgcaatcacaatgattagcatcttgctgaatgatgaccccaatgtgaagatggcatttcagtgtttatttctggatctatgagttactttagcagagttattagtagtttataaagccatatttaaacttgtacacttgattgtaagatagatttgaattgtgcactatgttgactactgtatataaatgtggaaattctgtatatttggtcttaatgctatatgtatttgatgtgtaaatgataactaatggatatgaaatagttttctgtgaatgtctttcttccaatttacttctcttttgcaaatttgaatgtttaaacttcaggctcatggggaaaatctgaaatgtttgcatctaatatactgttaagtggtggtctcttagatgactgggagagtattttagttgtaaggctcttgtataattaaaacagaggtaatgaattttttaggcatataactttgatagaatttcaagtgagtggcttttaagaagaaaaacagatctctggaatatgctgtcccatcctctcctgcttttatttcatgcccagtgtgcctcagagtgttacgaagtgtgagaaccactggtagagagaagacaaggaggagagggagagctgggagcacatgttgagacctttactatggctaggccttataatagaccaatttccccttgtataaatattgtctcaattaggcagggtgcagtggctcatgcctgtaatcccaggactttgggaggccaaggtgggcagatcacctgaggttgggagtttgagaccagcctgaccaacatggagaaaccctgtctctactaaaaatacaaaattagccgggcatggtggtgcatgcctgtaatcccagctacttgggaggctgaggcaggagaatcgcttgaacccaggaggtggaggctgcagtgagctgactttgtgccattgactccagcctgggcaacaagagcaaaactccatctcaaacacacacacacacacacacacacacacacacacacacacacacatatagtctcaattagttttcatacctcttcaataaagtaattattgttcccaaattacagatgaagaaagacgtttgggatgataaactggcatatggtaatatggccatgatatgctcaagtctttagggtcagagattcacagcaagattttggaaattcaaatcttactatgaagtgattcacacatgtgtatggtaatgaaccttaaaggatagctgggcctataggcatgtcaagatctatagagacatgcaggatgtttcaaattctatcttaaaatttgaccaaatctttggtcaaataataatactgttactcaaatattagctttttaccatttagagcaaattacaatcaggtaacattcaaaattctaaccctcccttcccaacatgggaatatctattaagtaggaaatgagagaaccccctaatttcccatttcagtgataatactgattgagtatctcttatctgaagtgcttgggaccagaagtgttttggatctgggtttttctcagattttgaaatatttgcattataccagttgagtatcccaaaatcaaaactggaaatctgaaatgatccaatgtccgtttcctttgagtgtcatgttagtgctcaaaaagttttggattttggagcgtttcagattttggatttttggatttgggatgctcgacctgtagtttggttttcatctttttagactccatttctcttgacctataaatcctatcagccctgtttattaacatagaccctagtcagaaatactttgaaatagatctacatctacttcaacgtcagttggttccacacccttctagaacttgtgtggggtcctggacttcccgtctgtcctgttagggaagctttgctgtcctagctttcaggactcatcagagggaagagggtcatttacctttccaatgtgctgtgatctcagagtcgttaaaatacatgttttgctgccatttgtac

SEQ ID NO: 14 - DNA, 3846 bp, Homo sapiens
gcagtgcgcacgtcaaagccgggctcgggccgcaagcggggcgaggggttcggggagcggcgcggcctgggagacacagagccttcaggcgccggggcgggggcacaggcgaagactaaggcggcgccgggccccacagcagcagccgcagcccaagcgagcgcagcagcgcggcggcagccgcgggagcccctgggcagccgtccgcccgcgcagccgccgccgccgcgggagcccgtcgccgggagcaggagcgggcggaagacaacggaggggccgagcgtccgagccactccgcggggaccgaacgagcagcccgaagcggcggcggccgaggacggggacagcgacgacgcggaggcagagaagggaacgcccggcccagccccgtagcacaggcggagtgcagcggaggcccctgccgctgccgtcatgccgttcccgtttgggaagtctcacaaatctccagcagacattgtgaagaatctgaaggagagcatggctgttctggaaaagcaagacatttctgataaaaaagcagaaaaggctacagaagaagtttccaaaaatctggttgccatgaaagaaattctgtatggcacaaatgaaaaagagcctcagacagaagcagtagctcaacttgctcaagaactctataatagtgggctccttagcaccctggtagctgatttacagctcattgactttgagggcaaaaaagacgtggctcaaattttcaacaatattctcagaagacaaattggtacgagaactcctactgttgaatacatctgcacccaacagaatattttgttcatgttattgaaagggtatgaatctccagaaatagctctaaattgtggaataatgttaagagaatgcatcagacatgaaccacttgcaaaaatcattttgtggtcggaacagttttatgatttcttcagatatgtcgaaatgtcaacatttgacatagcttcagatgcatttgccacattcaaggatttacttacaagacataaattgctcagtgcagaatttttggaacagcattatgatagatttttcagtgaatatgagaagttacttcattcagaaaattatgtgacaaaaagacagtcactgaagcttctcggtgaactactactagatagacacaacttcacaattatgacaaaatacatcagtaaacctgagaacctcaaattaatgatgaacctgctgcgagacaaaagtcgcaacatccagtttgaggcctttcacgtttttaaggtgtttgtagccaatcctaacaagacgcagcccatcctagacatcctcctcaagaaccaggccaaactcatagagttcctcagcaagtttcagaacgacaggacggaggatgagcagtttaacgacgagaagacctatttagttaaacagatcagggatttgaagagaccagctcagcaagaagcttaatctccaataaacatctatgttaaatccaaattcagcatttgctgttagctattcagcatcaggcactcttattgattcatgaggaacattactgctaatctgctgttaagtgaacggtttttcattttacccttttgtttttcagtccaggttggagatcgtagctgctgctgcttgcacactagggcacatgtgggctttctcttgatctttgtgtcatttcagaattcaaagactgtgctacgggagttctgaacatggctgggttcatgaaggcaaatgtatggatgagagtgtggtttaggaaagagggcactgatatcagattagacctatgtgtttgcacccatctttgttggcgatctgagtgcagtgtggcaagtgcacacctggcatccctgcgtcagatcgcgcaccttcaggtcgcgcaccttcgctgaaggaagatgacgcagagctttatctgaaatcagaggggagctatccaaaatgggagtttgggggcagctaaagttgacatgcgaataaattgatactgaaacttagcaacttcttaaaagtgtaaagaagcctcataagatcataaggaaaatgtatatatgcttttcacagctttctagaattttttgacatttgattttcttgagacttgtaaacctggatatgttgaagggtatttgttaattttacttttcaaagatactttaaaacagtagagctagcaatgacaccttgcatttcatttcaacactgcttcaaggtttcttttgtatataattcttagaatgctcatttcttttaaatggtttaatttgtacagcagaggaatgttattgtagtagtatgtaactattacctaatactgagtttttgcaaaaaacaatgaatgctcatatgtaattgaaatacttcagatcacatgaaaatgctgatttaacatttaagtatcacagcattaaaagaaaaagaaagtaaaccagtcctttgtattcagttacctaatggggtgccatcaataagctgcgatacagccctggagctcagtcagccacaccttcctgcatcctattggccttattcattttaaatgagttaatgaatctgccagatctgtgaatgatagagattatgctaaattaatgctgattctttgtgtgtgtgggaaatctctgtagagcaccttttctttcttagactaagtaacccagtacaatagttgtgaactgaataattaaaactttggcttctcttaggaaaagacgacttcctagtcataggtgtcctatggggaaatttattttttttaatgtcctgttccttaatgctgcaaattatcagtatttataaagtaactgattttgcaccacttttttgttactgtgaccacggcagaacaatgtcttctagactatatctatgtaaagttattagaatggtatctgttcattttagtgatatgaagatcacaactaacaactgacaaatcagagtttgccagttcaaattcagcatggctgcagctgattaagaaattgatatgattattctttgctagcctctcttactaatggaattatatactggccagtaaaatgggcctcccaattgctgtttcagcaggttttaaaccttcaggaacaccagttaggaaaatagctccagaaaatatagatatattttatttttattaaaatggcagtctacatcataattggcatttctcaagactgtctttaccagaatctgtgtgaaataaggcaatctagtctccttgaaaaaaaaatctcttggatgtttaggaaggaagacttggccgtgatgtggtgtcctggctttgtggtgtagtgctgtgtgtatggagttagtgtaaaaacatggattacaccaagtggaagaaacgtcttcttgccaagctcattcttagaacttacacatctagaacagcttccactttggcagtgaggtcgtagccttttaggtggaagaagtgagggtgcagcgtgtcagacacaacattcatgttactcttacattggaatctgaaggtagttcagacttcgtgggttttgtttttaagcaaaacaatgtgaaaacatttaagtttgaaatgttgcatttgaagttatgatcatttaatatattcatattaccaagactattatactggaagtggtttttgtgttataaaggtttaattttacataaggcagttacttaatgtgatttttaacccttaaaaaagtggagatgtatacatttgttaacaatgccatgaaagcattttctttctcctaaggaaaagtgaatttcttatcagaatatctggctggccctgtaatttaaattaaaataaaattttggagaaacagcaaaaaaaaaaaaaaaaaa

SEQ ID NO: 15 - DNA, 2382 bp, Homo sapiens
ggccccgcctccttgagtggtgcggagctttgtgatgcggagcttcgtgatgcacgccccgatgcctgcggggctataaaaacgctcgcaagcgccaagtctcctcaggagccgccggcaagggggcaacgaggaagctcttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttaggtaaagtttcatctattcattctgatcaatctgatgtgttaatggtggatgtggcaaccagtatgcctgttgttatcaaggaggtgccaagctcagaggctgctgaagatgtcatggtggctgctcctcttgtgtgttctggaaaggtgctagaagtgcaggttgtgaaccaaacatctgtccatgtagatttgggttctcaacctaaagaaaatgaggctgaaccatcaacggcttcctcagtccccttgcaggatgaacaagaacctcctgcttatgatcaagctcctgaggtcactttgcaggctgatattgaggttatgtcaactgttcatatatcatctgtctataacgatgtgcctgtgactgaaggagttgtttatatcgagcaactgccagaacaaatagttatcccttttactgatcaagttgcttgtcttaaagaaaatgagcagtcaaaagaaaatgagcagtcaccacgagttagtcccaaatctgtagtagaaaagaccacctctggcatgtctaaaaaatctgtagagtctgtaaaacttgcacagttggaggagaatgcaaaatattcctcagtatatatggaggcagaagcaacagctctgctctctgacacatctttgaaaggtcagcctgaggtacctgcacaactcctggatgcagaaggtgctatcaaaataggctctgaaaaatctctgcaccttgaagtggagatcacttcaatagtctctgacaatactgggcaggaggagtctggggaaaactctgtaccccaggagatggaaggcaaacctgtgctctctggggaagctgcagaagcagtgcactcaggtacatctgtaaagtcatctagtggccccttccctcctgctccagaaggccttactgcaccagaaattgaaccagaaggggaatcaacagctgaataaggtttgatgaagccagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcctggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcataaaaaaaaaaaaaaa

SEQ ID NO: 16 - DNA, 5241 bp, Homo sapiens
gatgagtgatttcctgagcatgcctagggaatgacaggcatctccacaggcaggctgcatccaccttggctggggtgtcgtcattggctgcctattagaaaaacgacaggacaatgcataccaccgcctcccgactgtaaacataggggatatgtgttcacttagcatggacttctgggaggggccaaggaagggcggtctggagttttattgaatagagcagtgtgtattcggctgcctgcctgcccgcctgcttgctctctggctgtgctcctgcttaaagaaatcagtccttcctttccgacttagtcctcgggaagaagtttcagactacaaggtatcattggaacatttcaagatcatcaaatcaaattccacagggattggtgaccaaccagaaggctcagacatctgattgctgacctgtccagacatcatctggtctccctgaacctgaaatcacaccatggatgattttgagcgtcgcagagaacttagaaggcaaaagagggaggagatgcgactcgaagcagaaagaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcaggtagaggtgatggtggaagagaaaacaactgaaagccaggaggaaacagtggtaatgtcattaaaaaatgggcagatcagttcagaagagcctaaacaagaggaggagagggaacaaggttcagatgagatttcccatcatgaaaagatggaagaggaagacaaggaaagagctgaggcagagagggcaaggttggaagcagaagaaagagaaagaattaaagccgagcaagacaaaaagatagcagatgaacgagcaagaattgaagcagaagaaaaagcagctgcccaagaaagagaaaggagagaggcagaagagagggaaaggatgagggaggaagagaaaagggcagcagaggagaggcagaggataaaggaggaagagaaaagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatattttatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccatgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaatgtctttttctcacttatttttatgtacaatattgatagtgagaggtatgtctattataataaagattatggcacagtaaaacctgtaaaaaaaaaa

SEQ ID NO: 17 - DNA, 1319 bp, Homo sapiens
atacatagtttactttcatttttgactctgaggctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctagaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaaacga

SEQ ID NO: 18 - DNA, 2723 bp, Homo sapiens
gggagaaacgttctcactcgctctctgctcgctgcgggcgctccccgccctctgctgccagaaccttggggatgtgcctagacccggcgcagcacacgtccgggccaaccgcgagcagaacaaacctttggcgggcggccaggaggctccctcccagccaccgcccccctccagcgcctttttttccccccatacaatacaagatcttccttcctcagttcccttaaagcacagcccagggaaacctcctcacagttttcatccagccacgggccagcatgtctgggggcaaatacgtagactcggagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggttaaacagtcaaaaaaaaaaa

SEQ ID NO: 19 - DNA, 3419 bp, Homo sapiens
ccggcctcagggacgcaccggagccgcctttccgggcctcaggcggattctccggcgcggcccgccccgcccctcggactccccgggccgcccccggcccccattcgggccgggcctcgctgcggcggcgactgagccaggctgggccgcgtccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaagcttaaaaaaaaaaaaaaaaaa

SEQ ID NO: 20 - DNA, 1698 bp, Homo sapiens
ctgcctggggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagtactgaccaagtgccaggaagaggtcagccacatccctgctgtccacccgggttcattcaggcccaagtgcgacgagaacggcaactatctgccactccagtgctatgggagcatcggctactgctggtgtgtcttccccaacggcacggaggtccccaacaccagaagccgcgggcaccataactgcagtgagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaacaaaaaaaaaaaaaaaaaa

SEQ ID NO: 21 - DNA, 2583 bp, Homo sapiens
ataaaggacccgggtgtccttgagctgccatcagtcaggaggccgtgcagtccgagatgggctcgtctcgggcaccctggatggggcgtgtgggtgggcacgggatgatggcactgctgctggctggtctcctcctgccagggaccttggctaagagcattggcaccttctcagacccctgtaaggaccccacgcgtatcacctcccctaacgacccctgcctcactgggaagggtgactccagcggcttcagtagctacagtggctccagcagttctggcagctccatttccagtgccagaagctctggtggtggctccagtggtagctccagcggatccagcattgcccagggtggttctgcaggatcttttaagccaggaacggggtattcccaggtcagctactcctccggatctggctctagtctacaaggtgcatccggttcctcccagctggggagcagcagctctcactcgggaagcagcggctctcactcgggaagcagcagctctcattcgagcagcagcagcagctttcagttcagcagcagcagcttccaagtagggaatggctctgctctgccaaccaatgacaactcttaccgcggaatactaaacccttcccagcctggacaaagctcttcctcttcccagacctttggggtatccagcagtggccaaagcgtcagctccaaccagcgtccctgtagttcggacatccccgactctccctgcagtggagggcccatcgtctcgcactccggcccctacatccccagctcccactctgtgtcagggggtcagaggcctgtggtggtggtggtggaccagcacggttctggtgcccctggagtggttcaaggtcccccctgtagcaatggtggccttccaggcaagccctgtcccccaatcacctctgtagacaaatcctatggtggctacgaggtggtgggtggctcctctgacagttatctggttccaggcatgacctacagtaagggtaaaatctaccctgtgggctacttcaccaaagagaaccctgtgaaaggctctccaggggtcccttcctttgcagctgggccccccatctctgagggcaaatacttctccagcaaccccatcatccccagccagtcggcagcttcctcggccattgcattccagccagtggggactggtggggtccagctctgtggaggcggctccacgggctccaagggaccctgctctccctccagttctcgagtccccagcagttctagcatttccagcagctccggtttaccctaccatccctgcggcagtgcttcccagagcccctgctccccaccaggcaccggctccttcagcagcagctccagttcccaatccagtggcaaaatcatccttcagccttgtggcagcaagtccagctcttctggtcacccttgcatgtctgtctcctccttgacactgactgggggccccgatggctctccccatcctgatccctccgctggtgccaagccctgtggctccagcagtgctggaaagatcccctgccgctccatccgggatatcctagcccaagtgaagcctctggggccccagctagctgaccctgaagttttcctaccccaaggagagttactcaacagtccataagaagtcaactgttgtgtgtgtgcatgccttgggcacaaacaagcacatacactatatcccatatgggagaagtccagtgcccaggcatagggttagctcagtttccctccttcccaaaagagtggttctgctttctccactaccccaaggttgcagactctctcttatcaccccttcctccttcctcttctcaaaatggtagattcaaagctcctctcttgattctctcctactgtttaaattcccattccaccacagtgcccctcagccagatcaccaccccttacaattccctctactgtgtggaaatggtccattgagtaacacccccatcagcttctcaactgggaaacccctgaaatgctctcagagcacctctgacgcctgaagaagttataccttcctcttcccctttaccaaataaagcaaagtcaaaccatcatctggaaacagtggccacttttcactgacctttcttcgacatctagtcaacccacccaatatgccactgggctctcgctcccaattccaccccaccctccattacagagctcaccacgccctcctagatcaccgtccccaacacacccattgcctctcaaggcccttatctcagccccttcctgtggccacttccctcagtgctcagatgattccctgggtgagggagacactggggcaccctcagaggttgaagcaggctccctgctgtccctggatcctggacagatggctcagtaaactgtggggactaggtgcagactttttgccttcttggagtcctgggtctcctctgagagtctgggtggtgctcttcctacgcctctagaggtctctgtgttcctcattttccttcaaaagcgggctgtgtttctcttctaccttccagctgctcccacagaggaggaagacaataaatatttgttgaactgaaagc

SEQ ID NO: 22 - DNA, 3542 bp, Homo sapiens
gatgctgagaagtactcctgccctaggaagagactcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcacacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtatgacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagtgagactccgtcaaaaaaaaaaaaaa

SEQ ID NO: 23 - DNA, 1567 bp, Homo sapiens
cgccccacccgcgagccgcagccgcggccccacagcttctggggctggggccccggcagccgggcaggccggcctgacctcgacctccgccgtgcgggcccgaccggtgagtccagcccggcagtcgcaggacccggccgccagcctctccctccacctctccctgcccccagcgccaggcgcgggctgcgctcggtggcggcggcggggccctcaggcggccatggcggcaggcgccggggccgggtccgcgccgcgctggctgagggcgctgagcgagccgctgagcgcggcgcagctgcggcgactggaggagcaccgctacagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggcaccatactggacataccttttatgtgcactgggactttttatttaccagtcactggatgctattgatgggaaacaagccagaagaacaaactcttgttcccctttaggggagctctttgaccatggctgtgactctctttccacagtatttatggcagtgggagcttcaattgccgctcgcttaggaacttatcctgactggttttttttctgctcttttattgggatgtttgtgttttattgcgctcattggcagacttatgtttcaggcatgttgagatttggaaaagtggatgtaactgaaattcagatagctttagtgattgtctttgtgttgtctgcatttggaggagcaacaatgtgggactatacgattcctattctagaaataaaattgaagatccttccagttcttggatttctaggtggagtaatattttcctgttcaaattatttccatgttatcctccatggtggtgttggcaagaatggatccactatagcaggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtagctcacatgaccaaaagtgaactatatcttcaagacactgtctttttggggccaggtcttttgtttttagaccagtactttaataactttatagacgaatatgttgttctatggatggcaatggtgatttcttcatttgatatggtgatatactttagtgctttgtgcctgcaaatttcaagacaccttcatctaaatatattcaagactgcatgtcatcaagcacctgaacaggttcaagttctttcttcaaagagtcatcagaataacatggattgaagagacttccgaacacttgctatctcttgctgctgctgtttcatggaaggagatattaaacatttgtttaatttttatttaagtgttatacctatttcagcaaataaaatatttcattgctta

SEQ ID NO: 24 - DNA, 2474 bp, Homo sapiens
aaaggcggggcgggcggctgccaagccggccaataggcggctctccggctgctaagccgagagggcaggggcgccgtcagtagcaccaccgccttccaagtttccccttgtggatgcgcggccccgcggctctgctcctcccggcgcagaggggccgggagaggccacaggagcggacctggcacgggatttctgaggaacgggagaagactggcgcccgacccgctctggagggtcggtgaacgatgaagggccggcggcggcgacgccgagagtactgcaagttcgcgctgctgttggtgctgtacacgctggtgctgttgctcgtcccctccgtattggacggcggccgcgacggggacaagggcgccgagcactgccccggcctgcagcgcagcctgggagtgtggagcctggaggcggcggcggccggcgaacgcgagcagggagcggaggcgcgggccgccgaggaagggggcgcgaaccagtctcctcggttcccaagcaacctcagcggcgctgtcggggaggcagtgtctcgcgagaagcagcacatctacgtgcatgccacctggcgcaccggctcgtccttcctgggcgaactctttaaccagcacccggacgttttctacttgtatgagcccatgtggcatctatggcaggcgctgtatccgggcgacgccgagagcttgcagggcgcgctgcgcgacatgctgcgttcgctcttccgctgcgacttctccgtgctgcggctgtacgcgccgccgggggaccccgctgcgcgcgccccggacacggccaatcttaccacggccgccctcttccgctggcggactaacaaggtcatctgctcgccgccactgtgtcctggcgcaccccgtgcccgggccgaggtgggcctcgtcgaggacaccgcctgcgagcgcagctgcccacccgtggcgatacgcgccctggaggccgagtgccgaaagtacccggtggtggtcatcaaggacgtgcgcctgctcgatctgggcgtgctggtgcccctgttgcgtgatccaggcctcaacctgaaggtggtgcagcttttccgcgacccgagggcggtgcacaactcgcgcctcaagtctaggcagggactgctgcgcgagagcatccaggtgctgcgcacccgccagaggggcgaccgcttccaccgtgtgctgctggcgcacggcgtgggtgctcgccccgggggccagtctcgcgcgctgcccgccgcgccgcgcgccgatttcttcctgaccggtgcgctcgaggtgatctgcgaagcctggctgcgcgatctgcttttcgcgcgcggcgcgcccgcctggctgcggcgccgctacctgaggctgcgctatgaggacctggtgcggcagccacgcgcccagctgcgccgcctgctgcgcttctccgggctacgcgcgctcgcagcgctcgatgccttcgcgctcaacatgactcgcggcgcggcctacggcgccgaccggcccttccacctgtcagcgcgcgacgcccgggaggcggtgcacgcctggcgcgagcgcctgagccgagagcaggtgcgccaggtggaggccgcctgcgctccagccatgcgtctgctcgcctaccctcgcagcggagaggagggcgacgcggagcagcccagggaaggggagacgccgctggagatggatgccgacggcgccacgtagcctcccatccctgtccccggcacggatccgggtcagtcaccacgaacaggggcactcggcatgctgccccagcactggagaagcagcgctgtgggggcaatctgtcacactctcagagtctgggacttgacttgctaccaacaactgctgtgcaattctgctgagcaggaatatcatgagctgttcaataatgacggacgcattggttgagatgaagtttccagtaaggaagtgacagtgcaatgtggatatttatggctgtaaaataggaagagctttagttcccaggctgaacctgccactgctggagccatttcaacaaggcatcctcacaacaaagaagagatgtgatttggtaccatttcacaccagcaggtgtctggacgaaaacatcaatgtgaataagggccaagtgcagtcctgtcttgattaaattacttaataatattattaaataataataggtctgggcagtattgtttttaacctgactcatccagctgtccttcaaatagctccgtctccctctacccagaactgatttttaaaaagaagtaatttttctccctgggctgggaaaaccctaatgaactgaaacacacttttactttaaaatttttctgtctggcgtttttgtaatcatactattaaatgactctggagtcatgttaatgacaggatttgttttgtttggatgcagttcaattgcatggtttgggtaaaagctagcctacatacaaaggaatatgaagactgtggaagaaactg

SEQ ID NO: 25 - DNA, 4657 bp, Homo sapiens
ggttagtgatgaggctagtgatgaggctgtgtgcttctgagctgggcatccgaaggcatccttggggaagctgagggcacgaggaggggctgccagactccgggagctgctgcctggctgggattcctacacaatgcgttgcctggctccacgccctgctgggtcctacctgtcagagccccaaggcagctcacagtgtgccaccatggagttggggcccctagaaggtggctacctggagcttcttaacagcgatgctgaccccctgtgcctctaccacttctatgaccagatggacctggctggagaagaagagattgagctctactcagaacccgacacagacaccatcaactgcgaccagttcagcaggctgttgtgtgacatggaaggtgatgaagagaccagggaggcttatgccaatatcgcggaactggaccagtatgtcttccaggactcccagctggagggcctgagcaaggacattttcatagagcacataggaccagatgaagtgatcggtgagagtatggagatgccagcagaagttgggcagaaaagtcagaaaagacccttcccagaggagcttccggcagacctgaagcactggaagccagctgagccccccactgtggtgactggcagtctcctagtgggaccagtgagcgactgctccaccctgccctgcctgccactgcctgcgctgttcaaccaggagccagcctccggccagatgcgcctggagaaaaccgaccagattcccatgcctttctccagttcctcgttgagctgcctgaatctccctgagggacccatccagtttgtccccaccatctccactctgccccatgggctctggcaaatctctgaggctggaacaggggtctccagtatattcatctaccatggtgaggtgccccaggccagccaagtaccccctcccagtggattcactgtccacggcctcccaacatctccagaccggccaggctccaccagccccttcgctccatcagccactgacctgcccagcatgcctgaacctgccctgacctcccgagcaaacatgacagagcacaagacgtcccccacccaatgcccggcagctggagaggtctccaacaagcttccaaaatggcctgagccggtggagcagttctaccgctcactgcaggacacgtatggtgccgagcccgcaggcccggatggcatcctagtggaggtggatctggtgcaggccaggctggagaggagcagcagcaagagcctggagcgggaactggccaccccggactgggcagaacggcagctggcccaaggaggcctggctgaggtgctgttggctgccaaggagcaccggcggccgcgtgagacacgagtgattgctgtgctgggcaaagctggtcagggcaagagctattgggctggggcagtgagccgggcctgggcttgtggccggcttccccagtacgactttgtcttctctgtcccctgccattgcttgaaccgtccgggggatgcctatggcctgcaggatctgctcttctccctgggcccacagccactcgtggcggccgatgaggttttcagccacatcttgaagagacctgaccgcgttctgctcatcctagacggcttcgaggagctggaagcgcaagatggcttcctgcacagcacgtgcggaccggcaccggcggagccctgctccctccgggggctgctggccggccttttccagaagaagctgctccgaggttgcaccctcctcctcacagcccggccccggggccgcctggtccagagcctgagcaaggccgacgccctatttgagctgtccggcttctccatggagcaggcccaggcatacgtgatgcgctactttgagagctcagggatgacagagcaccaagacagagccctgacgctcctccgggaccggccacttcttctcagtcacagccacagccctactttgtgccgggcagtgtgccagctctcagaggccctgctggagcttggggaggacgccaagctgccctccacgctcacgggactctatgtcggcctgctgggccgtgcagccctcgacagcccccccggggccctggcagagctggccaagctggcctgggagctgggccgcagacatcaaagtaccctacaggaggaccagttcccatccgcagacgtgaggacctgggcgatggccaaaggcttagtccaacacccaccgcgggccgcagagtccgagctggccttccccagcttcctcctgcaatgcttcctgggggccctgtggctggctctgagtggcgaaatcaaggacaaggagctcccgcagtacctagcattgaccccaaggaagaagaggccctatgacaactggctggagggcgtgccacgctttctggctgggctgatcttccagcctcccgcccgctgcctgggagccctactcgggccatcggcggctgcctcggtggacaggaagcagaaggtgcttgcgaggtacctgaagcggctgcagccggggacactgcgggcgcggcagctgctggagctgctgcactgcgcccacgaggccgaggaggctggaatttggcagcacgtggtacaggagctccccggccgcctctcttttctgggcacccgcctcacgcctcctgatgcacatgtactgggcaaggccttggaggcggcgggccaagacttctccctggacctccgcagcactggcatttgcccctctggattggggagcctcgtgggactcagctgtgtcacccgtttcagggctgccttgagcgacacggtggcgctgtgggagtccctgcagcagcatggggagaccaagctacttcaggcagcagaggagaagttcaccatcgagcctttcaaagccaagtccctgaaggatgtggaagacctgggaaagcttgtgcagactcagaggacgagaagttcctcggaagacacagctggggagctccctgctgttcgggacctaaagaaactggagtttgcgctgggccctgtctcaggcccccaggctttccccaaactggtgcggatcctcacggccttttcctccctgcagcatctggacctggatgcgctgagtgagaacaagatcggggacgagggtgtctcgcagctctcagccaccttcccccagctgaagtccttggaaaccctcaatctgtcccagaacaacatcactgacctgggtgcctacaaactcgccgaggccctgccttcgctcgctgcatccctgctcaggctaagcttgtacaataactgcatctgcgacgtgggagccgagagcttggctcgtgtgcttccggacatggtgtccctccgggtgatggacgtccagtacaacaagttcacggctgccggggcccagcagctcgctgccagccttcggaggtgtcctcatgtggagacgctggcgatgtggacgcccaccatcccattcagtgtccaggaacacctgcaacaacaggattcacggatcagcctgagatgatcccagctgtgctctggacaggcatgttctctgaggacactaaccacgctggaccttgaactgggtacttgtggacacagctcttctccaggctgtatcccatgagcctcagcatcctggcacccggcccctgctggttcagggttggcccctgcccggctgcggaatgaaccacatcttgctctgctgacagacacaggcccggctccaggctcctttagcgcccagttgggtggatgcctggtggcagctgcggtccacccaggagccccgaggccttctctgaaggacattgcggacagccacggccaggccagagggagtgacagaggcagccccattctgcctgcccaggcccctgccaccctggggagaaagtacttctttttttttatttttagacagagtctcactgttgcccaggctggcgtgcagtggtgcgatctgggttcactgcaacctccgcctcttgggttcaagcgattcttctgcttcagcctcccgagtagctgggactacaggcacccaccatcatgtctggctaatttttcatttttagtagagacagggttttgccatgttggccaggctggtctcaaactcttgacctcaggtgatccacccacctcagcctcccaaagtgctgggattacaagcgtgagccactgcaccgggccacagagaaagtacttctccaccctgctctccgaccagacaccttgacagggcacaccgggcactcagaagacactgatgggcaacccccagcctgctaattccccagattgcaacaggctgggcttcagtggcagctgcttttgtctatgggactcaatgcactgacattgttggccaaagccaaagctaggcctggccagatgcaccagcccttagcagggaaacagctaatgggacactaatggggcggtgagaggggaacagactggaagcacagcttcatttcctgtgtcttttttcactacattataaatgtctctttaatgtcacaggcaggtccagggtttgagttcataccctgttaccattttggggtacccactgctctggttatctaatatgtaacaagccaccccaaatcatagtggcttaaaacaacactcacattta

SEQ ID NO: 26 - DNA, 3299 bp, Homo sapiens
gacgcgagcgggaggctgcgccagcggcgcccgccgggggcccgccgcactctgctctcggcctcccgggctgcggggacgggacggctgccggcgcggactttgcgggccgggagccgagtccaggacagagccggaaccgccgagggaggcgagagggcagtgcgcggagatggcggccgcggcggcggaggaagggatggagccacgggcgctgcagtacgagcagaccctgatgtatggccggtacactcaggaccttggggcctttgccaaagaggaagctgctcggattcgcctgggagggcctgaaccctggaaaggtcccccttcctctcgggctgccccagagctcttggaatatggacggagccgttgcgcccgatgccgcgtctgttctgtccgctgccacaagttcctagtatccagggttggtgaagattggatcttcctggtcctgctggggcttctcatggcattggtcagctgggtcatggactatgccattgctgcctgtctgcaagcccagcagtggatgtcccggggcttgaacaccagcatcttgctccagtacctggcctgggtcacctaccctgttgtcctcatcactttctcagccggattcacacagatcctggcccctcaggctgtcggctctggcatccctgagatgaagaccatcttgcggggagtggtgctgaaagaatacctcacactcaagacctttatagctaaggtcattgggctgacctgcgccctaggcagcgggatgccgcttggcaaagagggcccttttgtgcatatcgcaagcatgtgtgctgcccttctcagcaagttcctctccctctttgggggtatctatgagaatgaatcccggaacacagagatgctggctgccgcctgtgccgtgggggtgggctgctgcttcgcggcacctattggaggcgtcctcttcagcatcgaggtcacctccaccttctttgcagtgcggaactactggcggggcttcttcgctgccaccttcagtgccttcatcttccgggtcttggcagtctggaaccgggatgaagagactattacagccctcttcaaaacccgattccggctcgacttcccctttgacctgcaggagctgccagcctttgctgtcattggtattgctagtggcttcggtggagccctctttgtctacctgaaccggaagattgtccaggtgatgcggaagcagaaaaccatcaatcgcttcctcatgaggaaacgcctgctcttcccggctctggtgaccctgctcatctccacgctgaccttcccccctggctttggacagttcatggctggacagctctcacagaaagagacgctggtcaccctgtttgacaatcggacgtgggtccgccagggcctggtggaggagctagaaccacccagcacctcacaggcctggaacccaccacgtgccaacgtcttcctcaccctggtcatcttcattctcatgaagttctggatgtctgcactggccaccaccatcccagttccctgtggggccttcatgcctgtctttgtcattggagcagcatttgggcgtctggtgggtgaaagcatggctgcctggttcccagatggaattcatacggacagcagcacctaccggattgtgcctgggggctacgctgtggtcggggcagctgcgctggcaggagcggtgacacacacagtgtccacggctgtgatcgtgttcgagctcacaggccagattgcccacatcctgcctgtcatgatcgccgtcatcctggccaacgctgtcgcccagagtctgcagccctccctctatgacagcatcatccgaatcaagaaactgccctacctgcctgagctcggctggggccgccaccagcagtaccgggtgcgtgtggaggacatcatggtgcgggatgttccccatgtggccctcagctgcaccttccgggacctgcgtttggcactgcacaggaccaagggccgaatgctggccctagtggagtcccctgagtccatgattctgctgggctccatcgagcgttcacaggtggtggcattgttgggggcccagctgagcccagcccgccggcggcagcacatgcaggagcgcagagccacccagacctctccactatctgatcaggagggtccccctacccctgaggcttctgtctgcttccaggtgaacacagaagactcagccttcccagcagcccggggggagacccacaagcccctaaagcctgcactcaagagggggcccagtgtcaccaggaacctcggagagagtcccacagggagcgcagagtcggcaggcatcgccctccggagcctcttctgtggcagtccaccccctgaggctgcttcggagaagttggaatcctgtgagaagcgcaagctgaagcgtgtccgaatctccctggcaagtgacgcggacctggaaggcgagatgagccctgaagagattctggagtgggaggagcagcaactagatgaacctgtcaacttcagtgactgcaaaattgatcctgctcccttccagctggtggagcggacctctttgcacaagactcacactatcttctcactgctgggagtggaccatgcttatgtcaccagtattggcagactcattggaatcgttactctaaaggagctccggaaggccatcgagggctctgtcacagcacagggtgtgaaagtccggccgcccctcgccagcttccgagacagtgccaccagcagcagtgacacggagaccactgaggtgcatgcactctgggggccccactcccgtcatggcctcccccgggagggcagcccttccgacagcgacgacaaatgccaatgagcccctcgtgggtggcctaggatggtgctagccatgcccgtcagcccagaatgtgcatctttcattccttctgccttcggaaggcaggaggcagctacagctggaggctgcaccccagccccctccagacctggggtgccagcttctcccagttcatcctacctggaatctgacccactacccacctgcaacaagtcttccagaggcaggaagataggccctgccctggcaggatgggttggggtcacttgacccctgctccccctttgaggggaaaggggtggaactaagatgggtttataactggaacctccaatgaccagatgtatatagagatttacaaagatttttatattaatttaataaaacaaattcttaaatagaacaaaataaacacctaatgagccacttatatatagaaaaaaaaaaa

SEQ ID NO: 27 - DNA, 2126 bp, Homo sapiens
cccaagaaaaagagagggcatgggttgcggagccgacatcacggccggggtctttgctgtttagacgcctgggttcccggatcccagacacgcgcacgggcaggaagttagaccggagacagcgagtatagacagcccttctggataggggcagacgggtgggagctccgaaggggtgccggggcggtgatcgggaggtctccagcggcccgaaccagggtgaagaagaagcccgggtttccgcttccctccgggcgcgagaagaggggagccaggccgagccccggccctaccgccgccgccgccatgtggcccccagaccccgaccccgacccggaccccgagcctgccggcggctcccgtcccggccccgcggtccccgggctccgcgccctgctgccggcgcgggctttcctctgctctctcaaaggccgcctcctgctggccgagtcgggtctctcattcatcacttttatctgctatgtggcgtcctcagcatctgccttcctcacagcgcctctgctggagttcctgctggccttgtacttcctctttgctgatgccatgcagctgaatgacaagtggcagggcttgtgctggcccatgatggacttcctgcgctgtgtcaccgcggccctcatctactttgctatctccatcacggccatcgccaagtactcggatggggcttccaaagccgctggggtgtttggcttctttgctaccatcgtgtttgcaactgatttctacctgatctttaacgacgtggccaaattcctcaaacaaggggactctgcagatgagaccacagcccacaagacagaagaagagaattccgactcggactctgactgaaggcctggcgggtgccttggcaacctgagccacacaggcctccacccctgcgcctcacaggggtcgctggcgttggagcggaggcctggacttctgagttgcagagggggctgcggacacagcaggccccctacagcctcaggttctgcctgagcccagcctaccaggcttgcccctcagctcagcactgttgaccacgctgcgtatgagggcatcttgggtatcccactccttctccccatttctgtcccacaggccttcagccctttaacgtctctgccaaaaaccagcacaaggagacaaagcagagccttgtctgtatctgggcagcaggtgttccatgctgctaggtggcgggggtcgggggtcttctgtttcactaacaggaacaaagacagaaaccatgacagggctgccccgccaggccccggtgggtttgtctgcacttggtgctcctgcccacaccagccactttggtgacaatgacccttccaagaatctttggttcaaggagcaccagttccctcttcattcttgaagcagggagaaattgacctttgccttgtcgcccaggaagtggggctcggcacccataactaacacctcccacccttggaaaccatgtcttctgggggtgagatgaccattctgggtctaagactgtttcaaagaagagctcatagactgactggtccagaagacagagggtacaacagtggcatcacagtgacagtgtcatggggagctgggcgggcccagccaaaccctccttcttcctagagcccagccagcaggcaggagttcctggaccctcaggacagtgaacttccagacctcagggcaggtctatgggccactgcaggagatgagaccagccttctgtgttcacctaacgatttatactgtgtatctgtctttgatggaattttgtaactttttatatttttttatgcaaaagcagcttcttaacagatggcattttctgtgactctaggcctcacaaaagagccagagttctggacccatgtttggagcatttgtagccttattctcttgcgtgtgaatctcttaccctgaaaaaaagccataatgaattaagccagactgaccacttgcttggagtgtgtgcttgaaaaaaccagagcaatactgttgggtattgtatcaggcttcagtacaaactggtaacaccaatgtggatcctgacagctttcagttttagcaaaaatacacgtgaaatctgactaccatttaaaaaaaaaaaaaaaaaa

SEQ ID NO: 28 - DNA, 2882 bp, Homo sapiens
gcggccgcgggggccttgccttccgcactcgggcgcagccgggtggatctcgagcaggtgcggagccccgggcggcgggcgcgggtgcgagggatccctgacgcctctgtccctgtttctttgtcgctcccagcctgtctgtcgtcgttttggcgcccccgcctccccgcggtgcggggttgcacaccgatcctgggcttcgctcgatttgccgccgaggcgcctcccagacctagaggggcgctggcctggagcagcgggtcgtctgtgtcctctctcctctgcgccgcgcccggggatccgaagggtgcggggctctgaggaggtgacgcgcggggcctcccgcaccctggccttgcccgcattctccctctctcccaggtgtgagcagcctatcagtcaccatgtccgcagcctggatcccggctctcggcctcggtgtgtgtctgctgctgctgccggggcccgcgggcagcgagggagccgctcccattgctatcacatgttttaccagaggcttggacatcaggaaagagaaagcagatgtcctctgcccagggggctgccctcttgaggaattctctgtgtatgggaacatagtatatgcttctgtatcgagcatatgtggggctgctgtccacaggggagtaatcagcaactcagggggacctgtacgagtctatagcctacctggtcgagaaaactattcctcagtagatgccaatggcatccagtctcaaatgctttctagatggtctgcttctttcacagtaactaaaggcaaaagtagtacacaggaggccacaggacaagcagtgtccacagcacatccaccaacaggtaaacgactaaagaaaacacccgagaagaaaactggcaataaagattgtaaagcagacattgcatttctgattgatggaagctttaatattgggcagcgccgatttaatttacagaagaattttgttggaaaagtggctctaatgttgggaattggaacagaaggaccacatgtgggccttgttcaagccagtgaacatcccaaaatagaattttacttgaaaaactttacatcagccaaagatgttttgtttgccataaaggaagtaggtttcagagggggtaattccaatacaggaaaagccttgaagcatactgctcagaaattcttcacggtagatgctggagtaagaaaagggatccccaaagtggtggtggtatttattgatggttggccttctgatgacatcgaggaagcaggcattgtggccagagagtttggtgtcaatgtatttatagtttctgtggccaagcctatccctgaagaactggggatggttcaggatgtcacatttgttgacaaggctgtctgtcggaataatggcttcttctcttaccacatgcccaactggtttggcaccacaaaatacgtaaagcctctggtacagaagctgtgcactcatgaacaaatgatgtgcagcaagacctgttataactcagtgaacattgcctttctaattgatggctccagcagtgttggagatagcaatttccgcctcatgcttgaatttgtttccaacatagccaagacttttgaaatctcggacattggtgccaagatagctgctgtacagtttacttatgatcagcgcacggagttcagtttcactgactatagcaccaaagagaatgtcctagctgtcatcagaaacatccgctatatgagtggtggaacagctactggtgatgccatttccttcactgttagaaatgtgtttggccctataagggagagccccaacaagaacttcctagtaattgtcacagatgggcagtcctatgatgatgtccaaggccctgcagctgctgcacatgatgcaggaatcactatcttctctgttggtgtggcttgggcacctctggatgacctgaaagatatggcttctaaaccgaaggagtctcatgctttcttcacaagagagttcacaggattagaaccaattgtttctgatgtcatcagaggcatttgtagagatttcttagaatcccagcaataatggtaacattttgacaactgaaagaaaaagtacaaggggatccagtgtgtaaattgtattctcataatactgaaatgctttagcatactagaatcagatacaaaactattaagtatgtcaacagccatttaggcaaataagcactcctttaaagccgctgccttctggttacaatttacagtgtactttgttaaaaacactgctgaggcttcataatcatggctcttagaaactcaggaaagaggagataatgtggattaaaaccttaagagttctaaccatgcctactaaatgtacagatatgcaaattccatagctcaataaaagaatctgatacttagaccaaaagcaacattcgttctctaaccattctgtattgattatataagcaaaatgaaaagagaaacttaaatgaacacagctctttaacatggttcaggtacacatattttgacccaagtggatattttcttaaaaccaatcaataatagctagctattactgcagactataaaatctggatatagaaaggagacctgtatcaaactgcttttgtagtgtgttttcataacaacttatgactaaaaatatcacactgaataagagagcaggattgccaggtatttttctatttctctccttaattttatatgtatatagatatatttggcttatattctaagtcacctaagtacttaaaagttaagttggtaaagtatttactgactgcttataaacatttaaagacaaagacatttcaaataactgcagaaaaaatattgtagtttgaatatttaagcaataaaactgctagtgagttattgt

SEQ ID NO: 29 - DNA, 4246 bp, Homo sapiens
gctctcactctggctgggagcagaaggcagcctcggtctctgggcggcggcggcggcccactctgccctggccgcgctgtgtggtgaccgcaggccccagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggacccaagggctacaagggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctggggctcagccctgagctagtgtcacctgcacagggccctctgaggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcatcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctctaaaaaaaaaaaaaaaaaaaaa

SEQ ID NO: 30 - DNA, 3455 bp, Homo sapiens
gcttactcggcgcccgcgcctcgggccgtcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacagtggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagagctgtccgtggcacagtgcacgcagcggcccgtggacatcgtcttcctgctggacggctccgagcggctgggtgagcagaacttccacaaggcccggcgcttcgtggagcaggtggcgcggcggctgacgctggcccggagggacgacgaccctctcaacgcacgcgtggcgctgctgcagtttggtggccccggcgagcagcaggtggccttcccgctgagccacaacctcacggccatccacgaggcgctggagaccacacaatacctgaactccttctcgcacgtgggcgcaggcgtggtgcacgccatcaatgccatcgtgcgcagcccgcgtggcggggcccggaggcacgcagagctgtccttcgtgttcctcacggacggcgtcacgggcaacgacagtctgcacgagtcggcgcactccatgcgcaagcagaacgtggtacccaccgtgctggccttgggcagcgacgtggacatggacgtgctcaccacgctcagcctgggtgaccgcgccgccgtgttccacgagaaggactatgacagcctggcgcaacccggcttcttcgaccgcttcatccgctggatctgctagcgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccataaaaaaaaaaaaaaaa

SEQ ID NO: 31 - DNA, 1849 bp, Homo sapiens
aagagcgccacgcggtgggcgaggggatgccctagtaaattcgcaggtctcttgactctttccgcctttgtttacaaccctgccatgatctccctcttgcaaaagcgagggctacagaacaggcattcaggagtcctgtgctccagtcacagccttttctgttcttcagctaggagacaccaaaccctcaggaagatttactatagctaagagaaaactgcagcagaaagggcgcggctacctacttcttaaattccgtttgtggaccctcagactcttagtcccctactcccagatacagcggccctaccgtggctcctggcaaggtggcatccacttttgtagtaagcatggatctcggaatccctgacctgctggacgcgtggctggagcccccagaggatatcttctcgacaggatccgtcctggagctgggactccactgcccccctccagaggttccggtaactaggctacaggaacagggactgcaaggctggaagtccggtggggaccgtggctgtggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgctgccctgtcaaaccctgttcctgaccgatgaggagaagcgtctgctggggcaggaaggggtttccctgccctctcacctgcccctcaccaaggcagaggagagggtcctcaagaaggtcaggaggaaaatccgtaacaagcagtcagctcaggacagtcggcggcggaagaaggagtacattgatgggctggagagcagggtggcagcctgttctgcacagaaccaagaattacagaaaaaagtccaggagctggagaggcacaacatctccttggtagctcagctccgccagctgcagacgctaattgctcaaacttccaacaaagctgcccagaccagcacttgtgttttgattcttcttttttccctggctctcatcatcctgcccagcttcagtccattccagagtcgaccagaagctgggtctgaggattaccagcctcacggagtgacttccagaaatatcctgacccacaaggacgtaacagaaaatctggagacccaagtggtagagtccagactgagggagccacctggagccaaggatgcaaatggctcaacaaggacactgcttgagaagatgggagggaagccaagacccagtgggcgcatccggtccgtgctgcatgcagatgagatgtgagctggaacagaccttcctggcccacttcctgatcacaaggaatcctgggcttccttatggctttgcttcccactgggattcctacttaggtgtctgccctcaggggtccaaatcacttcaggacaccccaagagatgtcctttagtctctgcctgaggcctagtctgcatttgtttgcatatatgagagggtacctcaaatacttctgttatgtatctgtgattttatttcttctttgggtatagggttgaggggaaataagttttgagtgagaaataaacgttttagctgaaattgtaaaaaaaaaaaaa

SEQ ID NO: 32 - DNA, 2661 bp, Homo sapiens
atgcgcagctgggcggtgacagggtgacgctcggagcgtgggccgcgactctcacggatccggttccgccctctcgctgccgatccttcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagtgtttagaatctccagtggggaagaggaaaagaagcatgactgttagtacttctcaggacccatctttctcaggattaaaccagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaaaaaaaaaaaaaaaaaa

SEQ ID NO: 33 - DNA, 838 bp, Homo sapiens
tgctgtttgtggaaaataaagcattctataggcggagctagtgaacgcctcttttaaaacacgagtctccacacttccctgttcactttggttccagcatcctgtccagcaaagaagcaatcagccaaaatgatacctggaggcttatctgaggccaaacccgccactccagaaatccaggagattgttgataaggttaaaccacagcttgaagaaaaaacaaatgagacttacggaaaattggaagctgtgcagtataaaactcaagttgttgctggaacaaattactacattaaggtacgagcaggtgataataaatatatgcacttgaaagtattcaaaagtcttcccggacaaaatgaggacttggtacttactggataccaggttgacaaaaacaaggatgacgagctgacgggcttttagcagcatgtacccaaagtgttctgattccttcaactggctactgagtcatgatccttgctgataaatataaccatcaataaagaagcattcttttccaaagaaattatttcttcaattatttctcatttattgtattaagcagaaattaccttttctttctcaaaatcagtgttattgctttagagtataaactccatataaattgatggcaattggaaatcttataaaaactagtcaagcctaatgcaactggctaaaggatagtaccaccctcacccccaccataggcaggctggatcgtggactatcaattcaccagcctccttgttccctgtggctgctgataacccaacattccatctctaccctcatacttcaaaattaaatcaagtattttacaaaaaaaaaaaaa

SEQ ID NO: 34 - DNA, 940 bp, Homo sapiens
cttggttccgcccgcgcgtcacgtgaccccagcgcctacttgggctgaggagccgccgcgtcccctcgccgagtcccctcgccagattccctccgtcgccgccaagatgatgtgcggggcgccctccgccacgcagccggccaccgccgagacccagcacatcgccgaccaggtgaggtcccagcttgaagagaaagaaaacaagaagttccctgtgtttaaggccgtgtcattcaagagccaggtggtcgcggggacaaactacttcatcaaggtgcacgtcggcgacgaggacttcgtacacctgcgagtgttccaatctctccctcatgaaaacaagcccttgaccttatctaactaccagaccaacaaagccaagcatgatgagctgacctatttctgatcctgactttggacaaggcccttcagccagaagactgacaaagtcatcctccgtctaccagagcgtgcacttgtgatcctaaaataagcttcatctccgggctgtgccccttggggtggaaggggcaggattctgcagctgcttttgcatttctcttcctaaatttcattgtgttgatttctttccttcccaataggtgatcttaattactttcagaatattttcaaaatagatatatttttaaaatccttacagattgcctcctttgttttagacttttttcttcgtctgaaccaccccgggcaggtccttcccctcgggggcatggagggcggagagactgcctggctcacacagcaagcaggtggtggacccaggattcacacctgcccactccggcccgcgttcctaaccaccactctttacatgttggtgctttgactcttaggtcctggccccaagcttcagtttctcccataaaataaaagagtgtgagtaaatccaattccagagcataactggctccagatctcagat

SEQ ID NO: 35 - DNA, 2119 bp, Homo sapiens
agcgctggcggcggcggcaggtggcgcgggaggtcgcggcgcgccatggggctcccggcgctgctggccagtgcgctctgcaccttcgtgctgccgctgctgctcttcctggctgcgatcaagctctgggacctgtactgcgtgagcggccgcgaccgcagttgtgccctcccattgccccccgggactatgggcttccccttctttggggaaaccttgcagatggtactgcagcggaggaagttcctgcagatgaagcgcaggaaatacggcttcatctacaagacgcatctgttcgggcggcccaccgtacgggtgatgggcgcggacaatgtgcggcgcatcttgctcggagagcaccggctggtgtcggtccactggccagcgtcggtgcgcaccattctgggatctggctgcctctctaacctgcacgactcctcgcacaagcagcgcaagaaggtgattatgcgggccttcagccgcgaggcactcgaatgctacgtgccggtgatcaccgaggaagtgggcagcagcctggagcagtggctgagctgcggcgagcgcggcctcctggtctaccccgaggtgaagcgcctcatgttccgaatcgccatgcgcatcctactgggctgcgaaccccaactggcgggcgacggggactccgagcagcagcttgtggaggccttcgaggaaatgacccgcaatctcttctcgctgcccatcgacgtgcccttcagcgggctgtaccggggcatgaaggcgcggaacctcattcacgcgcgcatcgagcagaacattcgcgccaagatctgcgggctgcgggcatccgaggcgggccagggctgcaaagacgcgctgcagctgttgatcgagcactcgtgggagaggggagagcggctggacatgcaggcactaaagcaatcttcaaccgaactcctctttggaggacacgaaaccacggccagtgcagccacatctctgatcacttacctggggctctacccacatgttctccagaaagtgcgagaagagctgaagagtaagggtttactttgcaagagcaatcaagacaacaagttggacatggaaattttggaacaacttaaatacatcgggtgtgttattaaggagacccttcgactgaatcccccagttccaggagggtttcgggttgctctgaagacttttgaattaaatggataccagattcccaagggctggaatgttatctacagtatctgtgatactcatgatgtggcagagatcttcaccaacaaggaagaatttaatcctgaccgattcatgctgcctcacccagaggatgcatccaggttcagcttcattccatttggaggaggccttaggagctgtgtaggcaaagaatttgcaaaaattcttctcaaaatatttacagtggagctggccaggcattgtgactggcagcttctaaatggacctcctacaatgaaaaccagtcccaccgtgtatcctgtggacaatctccctgcaagattcacccatttccatggggaaatctgatgagcttgaatgttcaaacctgagacttattggaagtgtacatatgagtttttaaggagtgttgtgttgactttatatttaatttctaaatgtatattataatatttatgtgttttgactatactaccacaatctttaaatattaaaataatgaatttgtatcatttccaaataaagtaaaatttgaaggtacttttctggtattttaagattcctgttgggtaaaactcaccagtttagtattttcttagtgtatttaaccagattttacaatgcctacctggacttatttgtcatctttgcatctgttttctgtgagaagaaatcttagctgttttttatgttaacagttattagaaaatatatgtctgtgtgtgttattccagacgtatctctgtaaattcttctacagtcacttagattccctatttggaaaattgatccaagttaatttaatttttttttggtttgctgtactttagggaaagatgaacctgaaaaggtaacactgagaactgtcactctaacctctccagcttatctaacatgtcataaacataataaatctgtgttgtccaat

SEQ ID NO: 36 - DNA, 2173 bp, Homo sapiens
aagatgcatgggtccagagtataaaggaacccaggagcagctgaaggcaggtcagatgaaggctaggtggctggaactgcaaccatggtgcccagcttcctctccctgagcttctcctccttgggcctgtgggcttctgggctgatcttggtcttaggctttctcaagctcatccacctgctgctgcggaggcagacgttggctaaggctatggacaaattcccagggcctcccacccactggctttttggacatgccctcgagatccaggagacggggagcctggacaaagtggtgtcctgggcccaccagttcccgtatgcccacccactctggttcggacagttcattggcttcctgaacatctatgagcctgactatgccaaagctgtgtacagccgtggggaccctaaggcccctgatgtgtatgacttcttcctccagtggattgggagaggcctgctggttcttgaggggcccaagtggttgcagcaccgcaagctgctcacacctggctttcattatgatgtgctgaagccctatgtggccgtgttcactgagtctacacgtatcatgctggacaagtgggaagagaaagctcgggagggtaagtcctttgacatcttctgcgatgtgggtcacatggcgctgaacacactcatgaagtgcacctttggaagaggagacaccggcctgggccacagcagggacagcagctactaccttgcagtcagcgatctcactctgttgatgcagcagcgccttgtgtccttccagtaccataatgacttcatctactggctcaccccacatggccgccgcttcctgcgggcctgccaggtggcccatgaccatacagaccaggtcatcagggagcggaaggcagccctgcaggatgagaaggtgcggaagaagatccagaaccggaggcacctggacttcctggacattctcctgggtgcccgggatgaagatgacatcaaactgtcagatgcagacctccgggctgaagtggacacattcatgtttgaaggccatgacaccaccaccagtggtatctcctggtttctctactgcatggccctgtaccctgagcaccagcatcgttgtagagaggaggtccgcgagatcctaggggaccaggacttcttccagtgggatgatctgggcaaaatgacttatctgaccatgtgcatcaaggagagcttccgcctctacccacctgtgccccaggtgtaccgccagctcagcaagcctgtcacctttgtggatggccggtctctacctgcaggaagcctgatctctatgcatatctatgccctccataggaacagtgctgtatggcccgaccctgaggtctttgactctctgcgcttttccactgagaatgcatccaaacgccatccctttgcctttatgcccttctctgctgggcccaggaactgcattgggcagcagtttgccatgagtgagatgaaggtggtcacagccatgtgcttgctccgctttgagttctctctggacccctcacggctgcccatcaagatgccccagcttgtcctgcgctccaagaatggctttcacctccacctgaagccactgggccctgggtctgggaagtagctctgatgagaatggggtcccagatggctcaggctgtgacctccctgggcaccaccctccccaggctgggtgtggaggagttggggccccctgccttcaggaggcttgtagtttagaagggaagtaggcattaccatagacgactcctagaggacagtgctatgtaaaaatgtgtgtctataaatgtttatcatgcatgtattctagagctcattcatttattcaacaaacatttggtgagcacctatttcgttcgagaaacttcatttatctcctataattggcaaacttaaaaatgcagcagaaacttacattccaaccttagagactcatagtgagcacaaggaaagttttgccctgagattcatggttatggctgggtaccaccaaatagaagaatggcttaggggagtgccccttcactgagatgtgtttctttgttgaactttgtgtgtgtgtgtttagaatataacagacataagaaaaaattacctaaatgaagactgtacaaaataataaataattctgaagcagaaaaaaaaaaaaaaaa

SEQ ID NO: 37 - DNA, 1495 bp, Homo sapiens
tactacgtcatagttccgcgccgccccagccgggcggggtgggtgtgtcacccagatcgctccgcccccatccgcaggttctaactttggcctgggactctgcccctctacctcagcacagaatcgccccgggtcctactacagaatcaatccttgaacactgcctccacgtcgccggctcaatctgggcgagaacccagacttccaccgcagccccgcaatctgcagacctcagcggcagcgcaggtggcagacctgcctcctttgcctgtgagtcatggcagctcccatgaatggccaagtgtgtgtggtgactggtgcctccaggggtattggccgtggcattgccttgcagctctgcaaagcaggcgccacagtttacatcactggccgccatctggacacccttcgcgttgttgctcaggaggcacaatccctcgggggccaatgtgtgcctgtggtgtgcgattcaagccaggagagtgaagtgcgaagcctgtttgagcaagtggatcgggaacagcaagggcgtctagatgtgctggtcaacaatgcttatgcaggggtccagacgatcctgaacaccaggaataaggcattctgggaaacccctgcctccatgtgggatgatatcaacaacgtcggactcagaggccactacttttgctcagtgtatggggcacggctgatggtaccagctggccaggggctcatcgtggtcatctcctccccaggaagcctgcagtatatgttcaatgtcccctatggtgtgggcaaagctgcgtgtgacaagctggctgctgactgtgcccacgagctgcggcgccatggggtcagctgtgtgtctctgtggccggggattgtgcagacagaactgctgaaggagcatatggcaaaggaggaggtcctgcaggatcctgtgttgaagcagttcaaatcagccttctcatctgcggaaaccacagaattgagtggcaaatgtgtggtggctttggcaacagatcccaatatcctgagcctgagtggtaaggtgctgccatcctgtgaccttgctcgacgctatggccttcgggatgtggacggccgccccgtccaagactatttgtctttgagctctgttctctcacacgtgtccggcctgggctggctggcctcctacctgccctccttcctccgtgtgcccaagtggattattgccctctacactagcaagttctaaccctcctggtctgacactacgtctctgcttgtcttctcatttggacttggtggttcgtcctgtctcagtgaaacagcagcctttcttgtttacccatacccttgatatgaagagaagccctctgctgtgtgtccgtggtgagttctggggtgcgcctaggtcccttctttgtgccttggttttccttgtccttctttttactttttgccttagtattgaaaaatgctcttggagctaataaaagtctcatttctctttcaaaaaaaaaaaaaaaaa

SEQ ID NO: 38 - DNA, 7262 bp, Homo sapiens
ccagcccaagtttttagggtggggatccagactggttatacgtaccttcagtccttctcccagaggaaggcagaaacacctcaaagcctgcatgtaagaacatctactgagaaattattttaatcagacaccagctgagtgggagaaagaaaaagaacagagaagaacaaacaaaactcccttggtcttggatgtaagagaatccagcagagatggactggagtttcttcagagtagttgcaatgctgttcatttttctggtggtggtagaagttaacagtgaattccgaatccaggtaagagattataacactaaaaatggcaccatcaaatggcattcaatccgaaggcagaaacgtgaatggatcaagttcgcagcagcctgtcgtgaaggtgaagacaactcaaagaggaacccaatcgccaaaattcactcagattgtgctgcaaaccagcaagttacataccgcatctctggagtaggaattgatcagccaccatatgggatctttgtcattaatcagaaaactggtgaaattaatataacatccatagttgatcgagaggtcactcctttcttcattatctactgccgagctctgaactcaatgggccaagatttagagaggcctctagagctcagagtcagggttttggatataaatgacaaccctccagtgttttcaatggctacatttgcaggacaaatagaagaaaattctaatgcaaatacactggtgatgatactcaatgctactgacgcagatgaaccgaacaatttgaactcaaaaatagccttcaagattataagacaagaaccttcagattcaccaatgtttattatcaacagaaatactggagaaattcgaacgatgaataattttctagacagagagcaatacggccagtatgctcttgctgtaagaggctctgaccgagatggcggggcagatggcatgtcagcggaatgtgagtgcaacattaaaatcctcgatgtcaatgataatatcccttacatggaacagtcttcatataccatagaaattcaagaaaatactctaaattcaaatttgctcgagattagagtaattgatttggatgaagagttctcagctaactggatggcagtaattttctttatctctggaaatgaaggaaattggtttgagatagaaatgaatgaaagaacaaatgtgggaattttaaaggttgttaagcccttagattatgaagctatgcagagtctgcaactcagtattggtgtcagaaataaagctgaatttcatcattcaattatgtctcaatataaactgaaagcatctgcaatttctgtgactgtgttaaatgtaattgaaggcccagtgtttcgtccaggttcaaagacatatgttgtaactggtaatatgggatcaaatgataaagtgggagactttgtagctactgacctggacacaggtagaccttcaacgactgttaggtatgtaatgggaaataatccagctgacctgctagctgttgattcaagaacaggcaaactcactttgaaaaataaagttaccaaggaacagtacaatatgctcggaggaaaataccaaggaacgattctctctatagatgataatcttcaaagaacttgcactggtacaattaatattaacattcaaagttttggtaatgacgacaggactaatacagagccgaacactaaaattactaccaatactggcagacaagaaagtacttcttccactaactatgataccagcacaacttctactgactctagccaagtatattcttctgaacccggaaacggagccaaagatttgttatcagacaatgtacattttggtcctgctggcattggactcctcatcatgggattcttggtcttaggattggtcccatttttgatgatctgttgtgattgtggaggtgctcctcgtagtgcagctggctttgagcctgttcccgaatgttcagatggagcaattcattcatgggcagtagaaggaccacagcctgaacccagggatataaccactgtcataccacaaataccacctgataacgcaaatataattgaatgcattgacaactcaggagtttatacaaatgagtatggtggcagagaaatgcaagatctgggaggaggagagagaatgacaggatttgaactaacagagggagttaaaacttcaggaatgcctgagatatgtcaagaatactctggaacattaagaagaaattctatgagggaatgtagagaaggaggtctgaatatgaatttcatggaaagctacttctgtcagaaagcatatgcttacgcagatgaagatgaaggacgcccatctaatgactgtttgctcatatatgacatcgaaggtgtaggttcccctgctggctctgtgggttgttgtagcttcattggagaagacctggatgacagcttcttggataccctgggacctaaatttaagaagttggcagacatcagcctaggaaaagaatcatatccagaccttgatccttcttggccaccacaaagcactgaaccagtttgccttcctcaggaaacagagcccgttgttagtggacacccaccaatctccccacatttcggcactaccacagtaatttctgagagcacctatccctcgggacctggtgtactgcatcctaagcctattctcgatcctctgggctatggtaatgtcactgtgaccgagtcttacaccacctctgacactctgaagccctctgtgcacgttcacgataaccgaccagcatcaaacgtggtagtgacagagagagtggtcggcccaatctctggcgctgatttgcatggaatgttagagatgcctgacttgcgagatgggtcgaatgttatagtgacagaaagggtaatagcaccaagctctagtctacccacctctctgactatccatcatcctagagagtcttcaaatgtggtagtgacagaaagagtaatccaaccaacttccggcatgataggtagtctgagtatgcaccccgagttagccaatgcccacaatgtcattgtgacagagagggttgtttctggtgctggcgtaactggaattagtggcaccactgggatcagcggtggcataggcagcagtggcctggttggcaccagcatgggtgctgggagcggtgccctgagtggagctggcataagtggtggtggcattggcctgagcagcttgggagggacagccagcattggccacatgaggagttcctctgaccatcactttaaccaaaccattgggtccgcctcccctagcacagctcgaagtcgaatcacaaagtatagtaccgtgcaatatagcaagtagtcaggaccccagctcactttttcatagtcattgtggtttagatccaattcccaccactaaaaaaccaacaatgtgatttataacgcacaacttcgtgctcaggtcatctaggagcaaggtgagaaatcacaatgagaaaaataaatggaaacaccactgctaggggagagctctccttagcattcataaacttttctcttatattaggactaaggaactaaaacttgaggcagagtcttctttgtgcctgagtggcctgtagtccatctccagcatgtaactggccttacgatggcaattggcatcattctccttgctctgttttgcttttccatatagctcgagcaaaattcaaaaagaactaaatatgcaatatatgttcatatctatgggaaaaatctaaaatgtgtgccagatgccctgttggtttcacagataacataaataaaaattcaaccacagatttatacaagggttaaccattttttttaagtttgactacatagtcaagtccacaagccatcaagcactcctaccttaattattgcactagagaaaataaattccaaattaggaagtgtttcctaggaggaaaattccattagagagtggcaataggatgaggtttcttcagggtaaactagcaatgcctgagcctgaaccttaatgtggggcctcagttaaatctcctgtggagtcaaggattcttctgattctagtgtgtgtttagtgatagatgtagtcttgacgaatattgcttactggtgaggttgaggaatatcacactcgtctttccctttaccactgtggttttgacttaagaaagcaaaactcactaagtttacttctcgaattgaagcaagtgaggcctgacatggttgtcatcactagtggcaaatgaccttccaagtaagcagatgggaactgaattgtgttttcaggttttgtttttagtaggtgatattcattcgtatccagctctttattacatagctctgaagttaaaatgatttacataggccgagctgtggacaaaaaaaaaagaagcagcagcttgtagtatgcttaagctttggggaatttttttttaaggggatctaaaaaaatgtttttagaacatgtaaaatgtttaatggtgaaagttggaaaagaattcttctgtaaagtaataccatgctaattattcgcttttagtaagtaaagtagtggttgctttagcaaacctctgctgccattttgcaggaatcaaccaggaacctttagcagaattgacaatatggtgttgataagcatgaaataataatagaaacctattctgctagtttatctcaccctctaatttttctcactagcataaattttaaattcctgatttgatttgtcaataagatcttggcttatatatgctgatttataggtagtgtccaaattatatagtataacatatttttctagtttcaaaatttagtaatgtcctatttatgatatatcatttctgtgtgtttgctatgtagtattacccaattaaaaatctctaaaaagaattaaagcattctaagaaaaaggtaaatttactattgcatggtacagaaattttttctttcttaaatacaatgttactataagctcactaaaatgaaactctatatgacaaaataaaattagaaaaaaatttgccctggagttgtgaattatatacaacttttaaagaatttaccccaattactcaaatttcccaggaaattacaaagccaaagaatattcaacttcctccactggtcaaaagaggataggagtgaattactgaacctagagctattttgctctgtaacaacagataaggctaatattttaaaagccacagtatacatcttcttttaactctgtagaatatgtaaaattttgatagtctgtagtatgctaaatgcagaagtataaataaagtcattcaaagggagtcttttctttttctgacacttagggggccacattaaggatgggtaatctttccaggaataaagtcaaaaggtatttattaagacatacttgagtatgcctgggtccaggagttttaaggaatagaaataagtattaatgaattaattaagtaatttattaaagggaatggtagctgaccacaggaaacttgcttactgttttgatatgaaatatcatcacaagcttttcttaagacatctgatatcttccagagatattttttaggttgtcttgcaaacaacaaaatcactgtctttaataactgttgctgtcaaaatccattggttgttaagatccccccaatttagttacatctgaactcctaaacactgttaaacgatgggaaaaacaagaaaaaacatggccatttgagtcattgagtcatctatctttctaggaagatactttctaaccaaacttttcttccaggattgcaaattgatgggaaaaacaagaaaaactgaagtattagtcacctatctttctgggaagatactttccaactaattttttcttccaggattgcacactgattttccatttagtcctaaattttaaaattcccttttcaagacatcaacgattttagtagttatttaaaggcatgtcatttttcaatgaagaagttttgggcagaacttcattcttcttcttagatgtttactctagatcatatacatcatgtcatagaccaagaagagatatggaaattattttataagtgaatactataattaggattcaagctgagtttcagatcaacttgctcttaacaaaaggaaaaagaaatagtaatttaatactatgtatgtatggtttgaaaacaaaccacaatgtttataaaatatctatctgactgtctaaagaggtaatctttaggagcaaaaatcagtgtattataaatactttaccatttaatatcaaccaaaataccatctcaagctaattttgacactgaattacagatatatctgctacatattatttacttctaagcatgttgtctgatgtaattgcatttgcactgaaaaattaaaagaaaaagtacatatttagggttatttatatatcttcatctagacatctgttctacatttgtgtataaagtttttagcatcataatttttattcaagaaaatgttctgacaaaattttaattatatgtcttcaaaaattacattttttactctagtaagtagatgtttttagttatctggcaatttatttctgaatttataccaatgtttgattgtcatggtacaaaatatatgacaccctttaacttttgctggagttgaaaggcattataatctttagcataaatggccatgactattttggaaagacatttaagacccaaagcaaacttttaaaagtatttgccacattttcccatgcctatttcataaattccaacttttttttttacaatttctggatttttaagacccatttcacattgcactaggatacagcagtccacagtagagtgctactctccttgaaatcaaatctgtcttccacttccggattattcaatttatgttaggacaaatcttgactagatcaacctgttttccatcagataattttaaaacaatgtgtaatcttgtttgtctacattctctccccagtttagctgtatttgaattactaaatgctttatcgtcaaactgtacctagtctaacttatttttcttttgctgtcgttttacaagcattttaaaattctaatattcatctctggtggtgtttaacacaaggttctcttattcaagtttcaatataaaagtttttggattatttgggtgctagtttcttgcttggttatctgttcgtttttttaagttgatttgtaatttccaaagagttatgcatacagcaataaaattattaatatgc

SEQ ID NO: 39 - DNA, 3149 bp, Homo sapiens
ctgagctcagggaggagctccctccaggctctatttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccctggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagaggggagttacagatttcctgtagcaggtgtgggcttacagacacatggactgggctgggaggcgagcaaaggaagcagctgagactgttggagaacgcttacaagacttcatgcaagcaaggacatgaactcagaacactgaggtcagaagcatcctgctgtcatgacaccgctcgagtgaccttgaccttgaccaagtctgtcctgtttaggactgatttttcctattaggctagggtttggacctgatgttctcaagatgtctagaattgcatggctggccttgtggaatagatggttttgcattccagccaagtgtgctgtaaactgtatatctgtaatatgaatcccagcttttgagtctgacaaaatcagagttaggatcttgtaaaggaaaaaaaaaaaaaaacaaaacaaaatggagatgagtacttgctgagaaagaatgagggaaggagttggcatttgttgaaagtgtagtctttttctcttttttttttaattgcaacttttactttagatttaggaggtcgtgcgcaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatttgacagatgcagaaagaggttccacaggtgtgccttgattctgtcctaaaaccgtttcccggaagcttttcctggtgtgggcgcttctaacctaatcctcaatcgattccagaactattactctgtttccacagtgatactgtgtctaggttttagggaggacagttcattgatgttacttaagaatgctttccaggtggaaagttccttaagtttgaggcttcaaattccatacagcacattaaaatcccattcatgagtttgaaatactgctctgttgtcttggaaataccaatcagattgttggctgaagtgatgtggataaagaagggatcttagaaaaactaaaaaaaaaaaaaaaaaa

SEQ ID NO: 40 - DNA, 1731 bp, Homo sapiens
aactgcagcgccggggctgggggaggggagcctactcactcccccaactcccgggcggtgactcatcaacgagcaccagcggccagaggtgagcagtcccgggaaggggccgagaggcggggccgccaggtcgggcaggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaatttcttaaaaaaaaaaaaaaa

SEQ ID NO: 41 - DNA, 2695 bp, Homo sapiens
aataaaaaccttccacccgtcagtctagaaggataagagaaagaaagttaagcaactacaggaaatggctttgggagttccaatatcagtctatcttttattcaacgcaatgacagcactgaccgaagaggcagccgtgactgtaacacctccaatcacagcccagcaaggtaactggacagttaacaaaacagaagctgacaacatagaaggacccatagccttgaagttctcacacctttgcctggaagatcataacagttactgcatcaacggtgcttgtgcattccaccatgagctagagaaagccatctgcaggtgttttactggttatactggagaaaggtgtgagcacttgactttaacttcatatgctgtggattcttatgaaaaatacattgcaattgggattggtgttggattactattaagtggttttcttgttattttttactgctatataagaaagaggtgtctaaaattgaaatcgccttacaatgtctgttctggagaaagacgaccactgtgaggcctttgtgaagaattttcatcaaggcatctgtagagatcagtgagcccaaaattaaagttttcagatgaaacaacaaaacttgtcaagctgactagactcgaaaataatgaaagttgggatcacaatgaaatgagaagataaaattcagcgttggcctttagactttgccatccttaaggagtgatggaagccaagtgaacaagcctcagtgacacaagtcaaattcatagtttcactctgggttttttgttgttgtgtggttattattctcactacagaaagactgagtttcatgctcctggctatgtcagatgtgaattttcatgggaataataatcaaccttgcagcaagccaaagcaatgcctcgcttgggttcttcatgttcttactacccagcgttttttaccacctagatgggcctctctaagtctatttgctcaatgaaccttatcccaaacttgttgttttcatggtgtctgaaagaatgtgatgtcagcttttagaatgaaatcagtgttaaggtacctccagtgaaccaaacatgtgtcttaaatctaagccactgaaaacagaagggaatgtccaaggcaaatacaaatcatacacagcttgtaacaacatacagcctttctatgtgaaataatggaataaactaaagagtttctgaagactgaagctatctggatatcaagtctggagtaggcaaagcatttccatttctacatggattataaaactttgtgttggactcattggtccctaatgcttttgttcatcacttcttccagttatcagtggaattacctggtgaccattcatttggaccgaaatcctggaagtctcctactgaataaaagtctacaattggccctaaaatagaaactgaaaaacaggacatagaattttttcaccagaccacagcatgtggaaactttctttatcatttttgaacacttgttaacagatttgcacatagagggagagaaaaaaaatggagtaacagtcaaaataataataatcagtatccaggccaggcgtggtggttcacgcctgtaatcctagcactttgggaggccgaggcggatggagcacctgaggtcaggagtttgagaccagcctggccaacatggtgaaaccctgtctctactaaaaatacaaaaattagctgggcgtggtggtgcatgcctgtaatcccagctactccagaggctgacacaggacaatcacttgaacccaggaggcagaggttgtagtgagccgagatggcaaccctgcactccaacctgggtgacaagagcgaaactccatctcaaaaaaaaaaaaaaaaatcagtatccttcctcttagttatatttctgccacttaattcaaacagtcatatgcaggtcgcttaatttatttgtgcttttgtttcatcttctacaaggccctcttagctctaaaacttgacagtggaataaggaaatgtttttccaaatctgcattgccggtgagatcctcaacatcagcatgttgagatggacctcaaccccacctctaaccctgaaacacactactcgatattatcttaggtatgttttagggtttagtttgtaaaataataatttatttttgaaggaaatataaaatattaaagagtaataatagctatcattttttaagattcaatctaaaacaatggactctttttttttccatttgtgatgtagataagcaagacaattttgatcatgagtggtgaaaagaggatcaaacttgactattcttgcaatggcagtccagcaacaagcctttcatttacattaaattataacttttcattcattcctaaaccaaacttaaaattctgctttcctttgagtagaaggtatttaacttgttttgtttttccttcagaaggaatttaatgcaaacggattgcagtcagcactttctgaatgttttcacacagtatgcaaagcttacatcataccaaggagtggagagttgaagtttcctcccagtgactccagtgacagaccacacctagaaagcgtttctcttcctgagtatttcaaaaagatgtaaaagagctggggagagtatgggaagaaacaatacaggattgcctttaattaattaagaattgcctcctgataaaaggaaaaagaaattaatgctgg

SEQ ID NO: 42 - DNA, 2702 bp, Homo sapiens
gcgcgctctgctcggctgcaggctcaggaagcggcgcggcggcacgtgctgggccagagccccgcgccctgcgtccagccgccgggtgtgtgcgcccgcgtagcccagcgtcgcgcctcggcgcccccacgcgcccacgcagcggcgcggggacccgggcgggggcagagggagggcccggcccagggaggagaaggggccggtcctcccggcgcaggcagcagccgcggcagcccaggaggcggaggcagcggcaacggcagagacagcaacgtgcccgccgcagtcagcccggcctcgtcggacccgcaccggcccgcccgcccgcccgcaccgcgtcggggcgccctctccactgcgcgcggtacaaggaaatggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggcacaacagggttctatcaaggaggaaatggactgggcaacgcagccggtttcgggagtgtgcaccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggacaccacgacgtccgtgcgcattggccttatgatggaagagatgatcttcaaccttgcagatacacatctgttcttcaatgacctggaggattgtgaccagatccacgttgatgacgtctcatcagatgacaatggccaagatttaagcacatacaacttctccgctgacggcttccacagttcggccccaggagccaacctgtgcctgggctctggcgtgcacggcggcgtggactggatgaggaagctggccttccgctaccggcgggtgaaggagatgtacaatacctacaagaacaacgttggtgggttgataggcactcccaaaagggagacctggctacagctccgagctgagctggaagctctcacagacctctggctgacccactccctgaaggcactaaacctcatcaactcccggcccaactgtgtcaatgtgctggtcaccaccactcaactaattcctgccctggccaaagtcctgctatatggcctggggtctgtgtttcctattgagaacatctacagtgcaaccaagacagggaaggagagctgcttcgagaggataatgcagagattcggcagaaaagctgtctacgtggtgatcggtgatggtgtggaagaggagcaaggagcgaaaaagcacaacatgcctttctggcggatatcctgccacgcagacctggaggcactgaggcacgccctggagctggagtatttatagcaggatcagcagcatctccacctgccatctcaccctcagaccccctcgccttccccacctccccaccgagaactccagagacccagatgttggacaccaggaaggggccccacagccgagacgacgtgtccagtgaccatctcagaagccgtccatcagtccaaatgggggttctgagaaggaaagtacccaacattggcttcggagtatttgactttggggaaaagggctggctcggagtctagactcttctgtaagactcacagaacaaaagcaaggaattgctgatttggggggtgcctggtgatgaggaggggatgggtttgtcttgtcttctttttaatttatggactagtctcattactccggaattatgctcttgtacctgtgtggctgggtttcttagtcgttggtttggtttggttttttgaactggtatgtggggtggttcacagttctaatgtaagcactctattctccaagttgtgctttgtggggacaatcattctttgaacattagagaggaaggcagttcaagctgttgaaaagactattgcttatttttgtttttaaagacctacttgacgtcatgtggacagtgcacgtgccttacgctacatcttgttttctaggaagagggggatgctgggaaggaatgggtgctttgtgatggataaaaggcattaaataaaaccacgtttacattttgaa

SEQ ID NO: 43 - DNA, 2928 bp, Homo sapiens
ggtcccggggcgtggcctcccgcaggtgagtacgctgctccttcggtttccctgaaacctaacccgccctggggaggcgcgcagcagaggctccgattcggggcaggtgagaggctgactttctctcggtgcgtccagtggagctctgagtttcgaatcggcggcggcggattccccgcgcgcccggcgtcggggcttccaggaggatgcggagccccagcgcggcgtggctgctgggggccgccatcctgctagcagcctctctctcctgcagtggcaccatccaaggaaccaatagatcctctaaaggaagaagccttattggtaaggttgatggcacatcccacgtcactggaaaaggagttacagttgaaacagtcttttctgtggatgagttttctgcatctgtcctcactggaaaactgaccactgtcttccttccaattgtctacacaattgtgtttgtggtgggtttgccaagtaacggcatggccctgtgggtctttcttttccgaactaagaagaagcaccctgctgtgatttacatggccaatctggccttggctgacctcctctctgtcatctggttccccttgaagattgcctatcacatacatggcaacaactggatttatggggaagctctttgtaatgtgcttattggctttttctatggcaacatgtactgttccattctcttcatgacctgcctcagtgtgcagaggtattgggtcatcgtgaaccccatggggcactccaggaagaaggcaaacattgccattggcatctccctggcaatatggctgctgattctgctggtcaccatccctttgtatgtcgtgaagcagaccatcttcattcctgccctgaacatcacgacctgtcatgatgttttgcctgagcagctcttggtgggagacatgttcaattacttcctctctctggccattggggtctttctgttcccagccttcctcacagcctctgcctatgtgctgatgatcagaatgctgcgatcttctgccatggatgaaaactcagagaagaaaaggaagagggccatcaaactcattgtcactgtcctggccatgtacctgatctgcttcactcctagtaaccttctgcttgtggtgcattattttctgattaagagccagggccagagccatgtctatgccctgtacattgtagccctctgcctctctacccttaacagctgcatcgacccctttgtctattactttgtttcacatgatttcagggatcatgcaaagaacgctctcctttgccgaagtgtccgcactgtaaagcagatgcaagtatccctcacctcaaagaaacactccaggaaatccagctcttactcttcaagttcaaccactgttaagacctcctattgagttttccaggtcctcagatgggaattgcacagtaggatgtggaacctgtttaatgttatgaggacgtgtctgttatttcctaatcaaaaaggtctcaccacataccatgtggatgcagcacctctcaggattgctaggagctcccctgtttgcatgagaaaagtagtcccccaaattaacatcagtgtctgtttcagaatctctctactcagatgaccccagaaactgaaccaacagaagcagacttttcagaagatggtgaagacagaaacccagtaacttgcaaaaagtagacttggtgtgaagactcacttctcagctgaaattatatatatacacatatatatattttacatctgggatcatgatagacttgttagggcttcaaggccctcagagatgatcagtccaactgaacgaccttacaaatgaggaaaccaagataaatgagctgccagaatcaggtttccaatcaacagcagtgagttgggattggacagtagaatttcaatgtccagtgagtgaggttcttgtaccacttcatcaaaatcatggatcttggctgggtgcggtgcctcatgcctgtaatcctagcactttgggaggctgaggcaggcaatcacttgaggtcaggagttcgagaccagcctggccatcatggcgaaacctcatctctactaaaaatacaaaagttaaccaggtgtgtggtgcacgtttgtaatcccagttactcaggaggctgaggcacaagaattgagtatcactttaactcaggaggcagaggttgcagtgagccgagattgcaccactgcactccagcttgggtgataaaataaaataaaatagtcgtgaatcttgttcaaaatgcagattcctcagattcaataatgagagctcagactgggaacagggcccaggaatctgtgtggtacaaacctgcatggtgtttatgcacacagagatttgagaaccattgttctgaatgctgcttccatttgacaaagtgccgtgataatttttgaaaagagaagcaaacaatggtgtctcttttatgttcagcttataatgaaatctgtttgttgacttattaggactttgaattatttctttattaaccctctgagtttttgtatgtattattattaaagaaaaatgcaatcaggattttaaacatgtaaatacaaattttgtataacttttgatgacttcagtgaaattttcaggtagtctgagtaatagattgttttgccacttagaatagcatttgccacttagtattttaaaaaataattgttggagtatttattgtcagttttgttcacttgttatctaatacaaaattataaagccttcagagggtttggaccacatctctttggaaaatagtttgcaacatatttaagagatacttgatgccaaaatgactttatacaacgattgtatttgtgacttttaaaaataattattttattgtgtaattgatttataaataacaaaattttttttacaacttaaaaaaaaaaaaaaa

SEQ ID NO: 44 - DNA, 3964 bp, Homo sapiens
ggcggagatgagcaggtccgcgacgctgctgctgtgcctgctgggctgccacgtctggaaggcggtgaccaagacgctgcgggagcccggcgccggagcccaagaggtgacgttaaaggtgcacatcagcgacgccagcacccaccagcccgtagcagatgcgctcatcgagatcttcaccaaccaggcctccatagcctctggcacctcggggactgatggcgtcgcctttatcaagttccagtataagctgggcagtcagttgattgtcaccgcctcgaagcatgcctacgtgccaaactctgccccatggaagccaatccggttacctgtattttcctctctgagccttggcctgcttccagaacgctctgccactctaatggtatatgaagatgtcgtccaaatagtatcaggattccaaggtgcccggccacagcctcgcgttcatttccagagaagggctctgaggttgcctgagaacaccagctacagtgacctgaccgcgtttctcacggccgccagctccccttcggaggtggacagttttccttatttgcgaggattagacggaaatggaacaggaaacagcaccaggcatgacctgaccccagtcacagccgtcagcgtccacttgctgagcagtaatggaacgccggtgctggtggatggtcccatctatgtcactgtgcccctggccacgcagagcagcctgaggcacaatgcctatgtcgcggcgtggcggtttgaccagaagctgggaacgtggctgaagagcggtctgggtcttgtgcaccaggaaggcagccagctgacgtggacatacattgccccccagttggggtactgggtggccgccatgtcccctcccatcccaggtcccgttgtaacacaggacattaccacgtatcacacggtgtttcttttggccattttaggaggaatggctttcatacttttggttttgctgtgtctccttttatattattgcaggaggaagtgcttgaaacctcgtcagcaccacagaaaactgcagctccctgcaggactggagagttccaaaagagaccagtccacgtccatgtcacacattaacttgctgttttcacgccgagcgtcagaattccctggcccgctgtccgtcaccagccacggccgccccgaggcccccggcacgaaggaactgatgagtggagtccatttggaaatgatgtctccgggcggcgaaggggacctgcacacccccatgctcaagctctcctacagcacctcccaggaatttagctcccgggaggagctcctctcttgcaaggaagaggataaaagccagatctcctttgataacctcactccaagtgggacgctggggaaagactaccataagtcagtggaggtttttcccttaaaggcaagaaaatctatggaaagagaaggctacgagtcctcgggcaatgatgactacaggggtagttacaacaccgtgctctcacagcctttatttgaaaagcaggacagagaaggtccagcctccacgggaagcaaactcaccattcaggaacatctgtaccccgcgccttcatcacctgagaaagaacagctgctggaccgcagacccactgaatgtatgatgtcgcgatcagtagatcacctcgagagacctacgtccttcccacggcccggccagttaatctgctgcagttctgtcgaccaggtcaatgacagcgtttacaggaaagtactgcctgccttggtcatcccggctcattatatgaaactccccggggaccactcctatgtcagccagcccctcgtcgtcccggctgatcagcagcttgagatagaaagactacaggctgagctgtccaatccccatgccgggatcttcccacacccgtcctcacagatccagccccagcccctgtcttcccaggccatctctcagcagcacctgcaggatgcgggcacccgggagtggagccctcagaacgcatccatgtcggagtctctctccatcccagcttccctgaacgacgcggctttggctcagatgaacagtgaggtgcagctcctgactgaaaaggccctgatggagcttgggggtgggaagccgcttccgcacccccgggcgtggttcgtctccttggatggcaggtccaacgctcacgttagacattcatacattgatctccaaagagctggaaggaacggaagtaatgatgccagtttggactctggcgtagatatgaatgaaccaaaatcagcccggaagggaaggggagatgctttgtctctgcagcagaactacccgcccgtccaagagcaccagcagaaagagcctcgagccccagacagcacggcctacacgcagctcgtgtacctggatgacgtggaacagagtggtagcgaatgtgggaccacggtctgtacccccgaggacagtgccctgcgatgcttgttggaggggtcgagtcggagaagtggtggccagctgcccagcctgcaggaggagacgaccagacggactgcggatgccccctcggagccagcagccagcccccaccagagaagatctgcccacgaggaagaggaagacgatgatgatgatgaccaaggagaagacaagaaaagcccctggcagaaacgggaggagaggcccctgatggcgtttaacattaaatgagctatcgcagacccacctgactgtggaatataaaattgccaaatatcctttctcatggaagcgcgtacccgttcgtggaggaaacggaacggcagcccagccgtgggacggacgtggacgtttactgcattcctgtttgccgtgtaaatgttagaaaggaattaaagttattactcggaataaaggatgactttggcggatgtcgcccctgcaaggaggtggctgaaagtggtgtccagatgtccttccgaggactcggcgtatccgccaccagggacattaagaaaccgcacgtgatgtcgctatgctctaacgatcacctcagttctccctcggattctgggaacagatgaaactttttgcatcgcttgagtcatttttatcacaataatcctactgtgaagctgtcgttgagaacttaggttggcacgtagcgtctcaaggtatgcgttctctcaaaggaaagctatgcatcgctgcttcgttgtctgattttgcttagattttgctttggttaggttgcgttttggggtttgcctttttttgttgtcgcttaaatgcaatttggttgtaaagatttgattcctttgtgttcatctgttccgcttctcagcggtccatctcagcgtctcccttcaggaaccgctgagtgtcctctcttaacatccaagccttttaatgaaatcgtactgaaatctgtatcagctaagagtcctccaatcctggtcccattaactccaagtgcctttttgacagtgacaacagacagtccctcgctttttgttgttgttggttttcttaacccctttaatggaactgcctggattttatacagttattaaaggatgtctcttttgctttaaactgcatgctgccaagtgccatttggggtcagcatcctcgtttcaacacagtgtgctctctagttatcatgtgtaacgtgggttctgtttagcgaagatagactagaggacacgttagagatgcccttccctgctccatccctgtggcaccattatggttttttggctgtttgtatatacggttacgtattaactctggaatcctatgggctcatcttgctcacccaatgtgggagtctggtttgagcaagcgagctgaatgtgactattaaaaaaaatttaaaaaaaaaaaagaaaatcttatgtactatccaaaagtgccagaatgactcttctgtgcattcttcttaaagagctgcttggttatccaaaaatgaaaattcaaaataaactctgaagaaaaggaaaaaaaaaaaaaaaa

SEQ ID NO: 45 - DNA, 1384 bp, Homo sapiens
tttgcccgactggccgcgcacccagctggcccgcccctgcccgacacgaccgctgcccgccccttgccttcctgacccaggggctccgctggctgcggtcgcctgggagctgccgccagggccaggaggggagcggcacctggaagatgcgcccattggctggtggcctgctcaaggtggtgttcgtggtcttcgcctccttgtgtgcctggtattcggggtacctgctcgcagagctcattccagatgcacccctgtccagtgctgcctatagcatccgcagcatcggggagaggcctgtcctcaaagctccagtccccaaaaggcaaaaatgtgaccactggactccctgcccatctgacacctatgcctacaggttactcagcggaggtggcagaagcaagtacgccaaaatctgctttgaggataacctacttatgggagaacagctgggaaatgttgccagaggaataaacattgccattgtcaactatgtaactgggaatgtgacagcaacacgatgttttgatatgtatgaaggtgataactctggaccgatgacaaagtttattcagagtgctgctccaaaatccctgctcttcatggtgacctatgacgacggaagcacaagactgaataacgatgccaagaatgccatagaagcacttggaagtaaagaaatcaggaacatgaaattcaggtctagctgggtatttattgcagcaaaaggcttggaactcccttccgaaattcagagagaaaagatcaaccactctgatgctaagaacaacagatattctggctggcctgcagagatccagatagaaggctgcatacccaaagaacgaagctgacactgcagggtcctgagtaaatgtgttctgtataaacaaatgcagctggaatcgctcaagaatcttatttttctaaatccaacagcccatatttgatgagtattttgggtttgttgtaaaccaatgaacatttgctagttgtatcaaatcttggtacgcagtatttttataccagtattttatgtagtgaagatgtcaattagcaggaaactaaaatgaatggaaattcttaaagggaatgatgtgattcaagctggaaagagggttgggagaaacagcttgtccaggtggagctatgttatgatcagatcgaagtgtgacccctgtgtggtccagacagccctgcagagagaaaacctttattccattatcaccaagcacctcctagtttccgacagtcatctccttctgctgggagaattagcagcagttcagggggcttatgttatgtccttgttcaactcaacttgagctcttgaactcctcctgtgggcctgtgaatgtattcattcattccacaactctgggtg

SEQ ID NO: 46 - DNA, 3291 bp, Homo sapiens
tgtgcgcgagttaagctgggggtgtggagcagccaagatggagccggcagtcggcggtccgggcccactgatcgtgaacaacaaacagccccagcccccgccacctccgccgccggcagccgcacagccaccacccggggcaccgcgggccgccgcgggcctcctgcctgggggcaaagcccgcgagttcaaccgcaaccagcgcaaagactcagagggctattcggagtcaccagacctggagtttgagtatgctgacacagacaagtgggctgcagagctctcggagctttacagctacacggaagggccagaattcctgatgaatcgaaaatgctttgaggaggacttccggatccatgtgacagacaagaagtggactgagctggataccaaccagcaccggacccatgccatgaggctcctggatggcttggaagtcactgccagggagaagagactcaaggtggctcgagcaattctctatgttgctcaaggcacgtttggggagtgcagctcggaggcagaggtgcagtcctggatgcgctacaacatctttctcctcctggaggtgggcacgttcaatgctttggtggagcttctgaacatggaaatagacaacagtgccgcctgcagcagtgctgtgaggaagcctgccatctccctggctgacagcacagacctcagggtcctgctcaacatcatgtacctgatagtggagaccgttcatcaggagtgtgagggtgacaaggctgagtggaggaccatgcggcagaccttcagagccgagctgggctccccgctgtacaacaatgagccatttgccatcatgctgtttgggatggtgaccaaattttgcagtggtcacgcccctcactttcccatgaagaaagttctcttgctgctctggaagacagtattgtgcacgctaggcggctttgaggagctgcagagcatgaaggctgagaagcgcagcatcctgggcctccccccgcttcctgaggacagcatcaaagtgattcgcaacatgagagcagcctctccaccagcatctgcttcagacttgattgagcagcagcagaaacggggccgccgagagcacaaggctctgataaagcaggacaacctagatgccttcaacgagcgggatccctacaaggctgatgactctcgagaagaggaagaggagaatgatgatgacaacagtctggagggggagacgtttcccctggaacgggatgaagtgatgcctcccccgctacagcacccacagactgacaggctgacttgccccaaagggctcccgtgggctcccaaggtcagagagaaagacattgagatgttccttgagtccagccgcagcaaatttataggttacactctaggcagtgacacgaacacagtggtggggctgcccaggccaatccacgaaagcatcaagactctgaaacagcacaagtacacgtcgattgcagaggtccaggcacagatggaggaggaatacctccgctcccctctctcagggggagaagaagaagttgagcaagtccctgcagaaaccctctaccaaggcttgctccccagcctgcctcagtatatgattgccctcctgaagatcctgttggctgcagcacccacctcaaaagccaaaacagactcaatcaacatcctagcggacgtcttgcctgaggagatgcccaccacagtgttgcagagcatgaagctgggggtggatgtaaaccgccacaaagaggtcattgttaaggccatttctgctgtcctgctgctgctgctcaagcactttaagttgaaccatgtctaccagtttgaatacatggcccagcacctggtgtttgccaactgcattcctttgatcctaaagttcttcaatcaaaacatcatgtcctacatcactgccaagaacagcatttctgtcctggattaccctcactgcgtggtgcatgagctgccagagctgacggcggagagtttggaagcaggtgacagtaaccaattttgctggaggaacctcttttcttgtatcaatctgcttcggatcttgaacaagctgacaaagtggaagcattcaaggacaatgatgctggtggtgttcaagtcagcccccatcttgaagcgggccctaaaggtgaaacaagccatgatgcagctctatgtgctgaagctgctcaaggtacagaccaaatacttggggcggcagtggcgaaagagcaacatgaagaccatgtctgccatctaccagaaggtgcggcatcggctgaacgacgactgggcatacggcaatgatcttgatgcccggccttgggacttccaggcagaggagtgtgcccttcgtgccaacattgaacgcttcaacgcccggcgctatgaccgggcccacagcaaccctgacttcctgccagtggacaactgcctgcagagtgtcctgggccaacgggtggacctccctgaggactttcagatgaactatgacctctggttagaaagggaggtcttctccaagcccatttcctgggaagagctgctgcagtgaggctgttggttaggggactgaaatggagagaaaagatgatctgaaggtacctgtgggactgtcctagttcattgctgcagtgctcccatcccccaccaggtggcagcacagccccactgtgtcttccgcagtctgtcctgggcttgggtgagcccagcttgacctccccttggttcccagggtcctgctccgaagcagtcatctctgcctgagatccattcttcctttacttcccccaccctcctctcttggatatggttggttttggctcatttcacaatcagcccaaggctgggaaagctggaatgggatgggaacccctccgccgtgcatctgaatttcaggggtcatgctgatgcctctcgagacatacaaatccttgctttgtcagcttgcaaaggaggagagtttaggattagggccagggccagaaagtcggtatcttggttgtgctctggggtgggggtggggtgtttctgatgttattccagcctcctgctacattatatccagaagtaattgcggaggctccttcagctgcctcagcactttgattttggacagggacaaggtaggaagagaagcttcccttaaccagaggggccatttttccttttggctttcgagggcctgtaaatatctatatataattctgtgtgtattctgtgtcatgttggggtttttaatgtgattgtgtattctgtttacattaaaaagaagcaaaaataaaaaaaaaaaaa

SEQ ID NO: 47 - DNA, 3371 bp, Homo sapiens
ggacgggcggaggggacgggaggcccagcggctccgggctccgctggctcgggcgtcggatcggagccgccggggcgcgggcggcccagagctggcctgaacctccaggacttcagcccttctaggagaatctgatcccaggtgagggaggtcacttggggtgtggcccagcaggcaggcgggactccagactgggaacggaagtcagccctgctggggctgggagctgaagcatctgttccttcctcgcgggtgtgagacaaggaagagtgatcattgccacaccaggagctgaagccatggcctcaaagcctgagaagagggtggcatcgtctgtctttatcaccctggcacccccgcgccgcgatgtggccgtggcggaggaagtgaggcaggcagtttgtgaggcccggcgtggccgcccctgggaggctcctgcccccatgaagacacccgaggctggcttggcggggaggcccagcccctggacaacccctggcagagctgcagccacagtgccggctgcacctatgcagctcttcaatggaggatgcccaccccctcctcctgtcctggatggtgaggacgtgcttcctgacctggacctcctcccaccccctccaccgccccctccagtgcttctgccttctgaagaggaggctcctgctccaatgggggcctcactcattgcagacttagagcagctgcacctgtccccgcccccgcccccaccacaggccccagcggagggaccttcagtccagcccggtcccctcaggcccatggaggaagagctgccacctcccccggcagaacctgttgagaaaggggcatccacagacatctgtgccttctgccacaagaccgtgtccccccgagagctggctgtggaggccatgaagaggcagtaccatgcccagtgcttcacgtgccgcacctgccgccgccagctggctgggcagagcttctaccagaaggatgggcgacccctctgcgaaccctgctaccaggacacactggagaggtgcggcaagtgtggcgaggtggtccgggaccacatcatcagggccctgggccaggccttccacccctcctgcttcacgtgtgtgacctgcgcccggtgcattggggatgagagctttgccctgggcagccagaacgaggtgtactgcctggacgacttctacaggaaattcgcccccgtctgcagcatctgtgaaaatcccatcatccctcgggatgggaaagatgccttcaaaatcgaatgcatgggaagaaacttccatgaaaattgctacaggtgtgaggactgcaggatcctcctgtctgtcgagcccacggaccaaggctgctaccccctgaacaaccatctcttctgcaagccatgccatgtgaagcggagtgctgcggggtgctgctgagagtgcccgctgggcagtgaacagaccactagccccggctggggcccttccctgacttggtttcccttcctaacctgctcttgcacactttccttctgagcctccatggagaccagcctgcaagccggcccagcctgtccaggatacagtggggctgagcacccccaggccttccactcctctaccctctgggcaccagaaggctcctggaccatgagcttcacccccagaattccctgctgaccctgccccacttccagggaaaagctgggggaggttggacccctctcactgactagctgtctggtaggggtgctaggaccagcctcgcctgtggggttgagctgtttgaggacaaactccaaggtcccttaaaaagtgccttttagaggctgggcatggtggctcacgcttgtaatcccagcactttgggaggccaaggtgggtggatcacctgaggtcaggagttcaagaccagcctggccaacatggtgaaaccctgtctctactaaaaatacaaaaattagccaggcatggtagcaggtgcctgtaatcccagctactggggaaagctgaggcaggagaattgcttcaatctggaaggcagaggttgcagtgagattgcaccattgcattccagcctgggcaacaagagggaaactccgtctcaaaaaaaaaaaagtgccttttaggccggatgtggtggctcatgcctgtaatcccagcactttgggaggccaaggcaggcagatcacttgaggtcaggagtttgagaccagcctggccaacacggcaaaaccccgtttctactaaaaatacaaaaattagctgggtgtggtggcgtgcgcctgtaatcccagctactcaggaggctgaggcaggagcattgcttgaacccgggaggcagaggttgcagtgagctgagatggcaccactgcactccagcctgggagacacagcgagactctgtctccaaaaaaaaaagtgctttttgaaaatgttgaggttgaaatgatgggaaccaacattctttggatttagtggggagcataatagcaaacacccccttggttcgcacatgtacaggaatgggacccagttggggcacagccatggacttccccgccctggaatgtgtggtgcaaagtggggccagggcccagacccaagaggagagggtggtccgcagacaccccgggatgtcagcatcccccgacctgccttctggcggcacctcccgggtgctgtgttgagtcagcaggcatggggtgagagcctggtatatgctgggaacagggtgcaggggccaagcgttcctccttcagccttgacttgggccatgcaccccctctcccccaaacacaaacaagcacttctccagtatggtgccaggacaggtgtcccttcagtcctctggttatgacctcaagtcctacttgggccctgcagcccagcctgtgttgtaacctctgcgtcctcaagaccacacctggaagattcttcttccctttgaaggagaatcatcattgttgctttatcacttctaagacattttgtacggcacggacaagttaaacagaatgtgcttccctccctggggtctcacacgctcccacgagaatgccacaggggccgtgcactgggcaggcttctctgtagaaccccaggggcttcggcccagaccacagcgtcttgccctgagcctagagcagggagtcccgaacttctgcattcacagaccacctccacaattgttataaccaaaggcctcctgttctgttatttcacttaaatcaacatgctattttgttttcactcacttctgactttagcctcgtgctgagccgtgtatccatgcagtcatgttcacgtgctagttacgtttttcttcttacacatgaaaataaatgcataagtgttagaagctcttccaaaaaaaaaaaaaaaaaa

SEQ ID NO: 48 - DNA, 3045 bp, Homo sapiens
ctttcttcactctgaagccaagagccgaccttctgagccctcaagaaagatcagaacagattcatgggtgatttagcctatctgtcccaggccagcgtggctgagtgtgctggctggaggcctctctctctgcttcgagggtagctgagatccaccccggaaaccggcaggatgaagggggcaagtgaggagaagctggcatctgtgtccaacctggtcactgtgtttgagaatagcaggaccccagaagcagcacccagaggccagaggctagaggacgtgcatcaccgccctgagtgcaggcctcccgagtccccaggaccacgggagaagacgaatgtcggggaggccgtggggtctgagcccaggacagtcagcaggaggtacctgaactccctgaagaacaagctgtccagcgaagcctggaggaaatcttgccagcctgtgaccctctcaggatcggggacgcaggagccagagaagaagatcgtccaggagctgctggagacagagcaggcctatgtggcgcgcctccacctgctagaccaggtgtttttccaggagctgctgaagacagcccgcagcagcaaggccttcccagaggatgtggtcagggtcatcttctccaacatctcctccatctatcagttccattctcagttcttcctcccagagctgcagcggcgcctggacgactggacagctaacccccgcatcggtgacgtgatccagaagctggcccccttcctgaagatgtacagtgagtatgtcaagaactttgagcgagcggctgagctgctggccacctggaccgacaagtctccactcttccaggaggttctcactcgcatccagagcagcgaggcttcgggcagcctgaccctgcagcaccacatgctggaaccagtgcagagaattccacgttacgagctgctgctcaaggagtacatccagaagctgccagcccaggccccagaccaggccgatgcccagaaagccctggacatgatcttctcagctgcccagcactccaatgcagccatcactgagatggagcggctgcaggacctgtgggaggtgtaccagcgcctgggcctcgaggacgacatagtagacccctctaacaccctgctccgtgagggcccggtcctcaagatctccttccgccgcaacgaccccatggagcgctaccttttcttgttcaacaacatgctgctctactgtgtgcccagggtgatccaggtgggcgcccagttccaggtgaggacccgcatcgatgtggccgggatgaaggtgcgggagctgatggatgctgagtttccccactccttcctggtgtccgggaagcagcgcaccctggagctgcaagcccggtcccaggaggaaatgatttcctggatgcaggccttccaagcagccattgaccaaatcgagaagcggaatgaaaccttcaaggctgcggcccaggggcctgagggagacatccaggagcaggagctgcagtctgaggagctgggcctccgggcaccgcagtgggtccgggacaagatggtgaccatgtgcatgcgctgccaggagcccttcaacgctctgacgcgccgtcgccaccactgccgggcctgcggctatgtggtgtgtgccaggtgctccgactaccgggccgaactgaaatacgacgacaacaggcccaaccgagtctgcctccactgctacgcattcctcactggaaatgtgctgcctgaggccaaggaggacaagaggcggggcatcctggagaaagggtcctcagccacgcctgaccagagcctgatgtgcagcttcctgcagctcatcggggacaagtggggcaagagcggcccccggggctggtgtgtgatccctcgggatgaccccctcgtgctctatgtctatgctgcccctcaggacatgagggctcacacctccatccccctgctgggctaccaggtgactgttgggccccagggggaccctcgggtcttccagctacagcagtcaggccagctctacaccttcaaggccgagacggaggagctgaagggccgctgggtgaaggccatggagcgggcggccagtggctggagccccagctggcccaacgatggggacctgtccgactgagccactgccagccgctctcctgcccacctctccccaccctgaacccagctcctgccacagactgaccctgtggcctcagtgacccactgccccaagtggtgctttcagagaattgattcagccatctgcgcccaggccacgtgtcccgatctgggattagaaaatatgggtccattcctttctagaaaggggacaaccaagtgtctcagtttgccttgcggggagggggctcctgggccatgggacttccagtgctaaaactgggaaagccccaggtaaccccggactggtggtcaccatagtatggtttttcatttgtatctcctggggagcttttaaagagtactggtgaaaaacacatagtaaattaattttaaaaatgtaaaaaacaatgcctgtactgaagtaccaccaccgatttaaatgggctgagttgggggaggcatggggtctttttttttttttttttgagacagagtcttactctgtttcccaggctggagtgcacaaacatggctcactacagcctcgctctcccgggctccagtgatcctcccgcctcagcctcccaagtagctgggattataggtgtgtgccactgtgccaagctaatttttttattttttgtagagatgggatttcaccatgttactcaggctggtctcaaactcccagcctcaagcgatgctcccacctccacctcccaaagtgctgggattacaggcgtgagccaccatacctggcgcatgcatattttttaagagtacccactggagtctaatatatagcctgggttacctgggatgaagaataaagagagcaaactaccacaaccaatggttgagcccctgtcaagtgccagtcatgatagtagtaataataataataaacatctattggaccagg

SEQ ID NO: 49 - DNA, 3480 bp, Homo sapiens
cccctggagctgcggccgggagggcgggcggccggggagacggggtggcggctgcagcccgggtagggccaggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccccgacggccagaagttcgactccagctatgacagagactccactttcaatgtgtttgtgggaaaaggacagctgatcacagggatggaccaggctcttgttgggatgtgcgtaaacgagagacgtttcgtgaagattcccccaaagcttgcctacggaaatgaaggagtttctggtgtgatcccccccaattcagtgcttcattttgatgtacttctgatggatatttggaattctgaagaccaggttcagattcacacctatttcaagcccccgagttgccctcggaccatccaggtgtctgattttgtgaggtaccactacaacgggacgttcctggacggaactctgtttgattcgagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatgggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgagctgctggagctggtggctggccttcctgaggggtacatgttcatatggaatggtgaggtgtcacccaacctctttgaagaaattgacaaggatggcaacggagaagtcctcctggaagagttctcagagtacattcacgcccaggtggcatctggcaaagggaaactcgctcctggctttgatgctgagctgattgtgaagaatatgttcaccaaccaggaccggaatggagatgggaaggtcacagccgaggaatttaaactcaaagaccaggaagccaaacacgatgaactctaaacctggcatgaaccagatggtgccagggagtacgtgacaccaagccacctgtgtggcaagacgtgcagtgagggtgcaagggtctctcagaagttgcatcattagccagtagtaggtgggtcacatagtacctggtgtacacatcggggtgggttgatatatggggtgagaagtttgggctgatcgccagtgatagtaaacaaaatctgtgcagagggccttagcatgggatgtgtccagtattgaaaaggctgcactgccaaccatgatttgtgagccttctgggaaattttgttattaaaggaatatatagtgtcagacggaagttataatcatcttggaggaaccataagaaaaggtgtccagggtatctatataaagagggttaaatttttttttaacttgctggttaaaacattttagaaatattctagagatgggcaggagagtcaaagggcttgcttgccccagcagagttcccagcagacagccatggctcttcccagcagcctgtgcaaattctgatgatggccccacccccgcacacgcacacgcacatcatgcttttccagctcatcacaccccgccccactatgggcctaccattaatagtgtataacttggaggttaaaagagccttttggacagaaaactgggccaggaaaaggcatctcagaccacaaatagagaatttgattcctcatttgccacataagtcatctgcttagcttttcctttcctttttttttttttttttttttctggaggcagagtctccctttgtcgccaggctggagtgcagtggtgccatctcggctcactgcagcactgtctcggctcactgcagcctccgcctcccgtattcaagcgattctcctgtctcagcctcctgagtagctgggactacaggtgtgcaccaccacgcccggctaatttttgtatttttagtagagacggggtttcactgtgttggccaggatggtctcaatctcgacctcgtgatccgcccaccttggcctcccaaagtgttgggattacaggcgtgactcaccatgcccagccacttagttttttcttattcccacctttctatcccatagaacactcttttttatcttccctgaaccatattgatgagataaatagggctgggggctgggccccgctggtcactcaacagagtatttcccttggccgagatggaagttttgtcccaatagatgagctgctgagcatcaacaaggtgacatttttctgctgcccatttgtgtcctggagacggtggtaccctgaaggcagaggccagctgccgcaagacagcaatgacagtccacctgccgacctgattcctgcatcatggaataaccacatggctaccttctatcctctgttcccaaatggtggtggcacttatcctgaagtcgtcaatgatttccctttgaaactactttattttactaatttaaactattttgtactgatgtagccctgaggtagttcatgaaaatgctgtgcactcattccatggaataaatgttggaaagctgatcttttctgatataaaatgttgaatgatattaaaaaaaaaaaaaaaaaa

SEQ ID NO: 50 - DNA, 8833 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagaggtgccccaactcactgacctaagctttgttgatataaccgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacggctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaagtatttgaatagtaaaaaaaaaaaaaaaaaaa

SEQ ID NO: 51 - DNA, 3396 bp, Homo sapiens
gggcttcctcttcgcccgggtggcgttgggcccgcgcgggcgctcgggtgactgcagctgctcagctcccctcccccgccccgcgccgcgcggccgcccgtcgcttcgcacagggctggatggttgtattgggcagggtggctccaggatgttaggaactgtgaagatggaagggcatgaaaccagcgactggaacagctactacgcagacacgcaggaggcctactcctccgtcccggtcagcaacatgaactcaggcctgggctccatgaactccatgaacacctacatgaccatgaacaccatgactacgagcggcaacatgaccccggcgtccttcaacatgtcctatgccaacccgggcctaggggccggcctgagtcccggcgcagtagccggcatgccggggggctcggcgggcgccatgaacagcatgactgcggccggcgtgacggccatgggtacggcgctgagcccgagcggcatgggcgccatgggtgcgcagcaggcggcctccatgaatggcctgggcccctacgcggccgccatgaacccgtgcatgagccccatggcgtacgcgccgtccaacctgggccgcagccgcgcgggcggcggcggcgacgccaagacgttcaagcgcagctacccgcacgccaagccgccctactcgtacatctcgctcatcaccatggccatccagcaggcgcccagcaagatgctcacgctgagcgagatctaccagtggatcatggacctcttcccctattaccggcagaaccagcagcgctggcagaactccatccgccactcgctgtccttcaatgactgcttcgtcaaggtggcacgctccccggacaagccgggcaagggctcctactggacgctgcacccggactccggcaacatgttcgagaacggctgctacttgcgccgccagaagcgcttcaagtgcgagaagcagccgggggccggcggcgggggcgggagcggaagcgggggcagcggcgccaagggcggccctgagagccgcaaggacccctctggcgcctctaaccccagcgccgactcgcccctccatcggggtgtgcacgggaagaccggccagctagagggcgcgccggcccccgggcccgccgccagcccccagactctggaccacagtggggcgacggcgacagggggcgcctcggagttgaagactccagcctcctcaactgcgccccccataagctccgggcccggggcgctggcctctgtgcccgcctctcacccggcacacggcttggcaccccacgagtcccagctgcacctgaaaggggacccccactactccttcaaccacccgttctccatcaacaacctcatgtcctcctcggagcagcagcataagctggacttcaaggcatacgaacaggcactgcaatactcgccttacggctctacgttgcccgccagcctgcctctaggcagcgcctcggtgaccaccaggagccccatcgagccctcagccctggagccggcgtactaccaaggtgtgtattccagacccgtcctaaacacttcctagctcccgggactggggggtttgtctggcatagccatgctggtagcaagagagaaaaaatcaacagcaaacaaaaccacacaaaccaaaccgtcaacagcataataaaatcccaacaactatttttatttcatttttcatgcacaacctttcccccagtgcaaaagactgttactttattattgtattcaaaattcattgtgtatattactacaaagacaaccccaaaccaatttttttcctgcgaagtttaatgatccacaagtgtatatatgaaattctcctccttccttgcccccctctctttcttccctctttcccctccagacattctagtttgtggagggttatttaaaaaaacaaaaaaggaagatggtcaagtttgtaaaatatttgtttgtgctttttccccctccttacctgaccccctacgagtttacaggtctgtggcaatactcttaaccataagaattgaaatggtgaagaaacaagtatacactagaggctcttaaaagtattgaaagacaatactgctgttatatagcaagacataaacagattataaacatcagagccatttgcttctcagtttacatttctgatacatgcagatagcagatgtctttaaatgaaatacatgtatattgtgtatggacttaattatgcacatgctcagatgtgtagacatcctccgtatatttacataacatatagaggtaatagataggtgatatacatgatacattctcaagagttgcttgaccgaaagttacaaggaccccaacccctttgtcctctctacccacagatggccctgggaatcaattcctcaggaattgccctcaagaactctgcttcttgctttgcagagtgccatggtcatgtcattctgaggtcacataacacataaaattagtttctatgagtgtataccatttaaagaatttttttttcagtaaaagggaatattacaatgttggaggagagataagttatagggagctggatttcaaaacgtggtccaagattcaaaaatcctattgatagtggccattttaatcattgccatcgtgtgcttgtttcatccagtgttatgcactttccacagttggacatggtgttagtatagccagacgggtttcattattatttctctttgctttctcaatgttaatttattgcatggtttattctttttctttacagctgaaattgctttaaatgatggttaaaattacaaattaaattgttaatttttatcaatgtgattgtaattaaaaatattttgatttaaataacaaaaataataccagattttaagccgtggaaaatgttcttgatcatttgcagttaaggactttaaataaatcaaatgttaacaaaagagcatttctgttattttttttcacttaactaaatccgaagtgaatatttctgaatacgatatttttcaaattctagaactgaatataaatgacaaaaatgaaaataaaattgttttgtctgttgttataatgaatgtgtagctagtaaaaaggagtgaaagaaattcaagtaaagtgtataagttgatttaatattccaagagttgagatttttaagattctttattcccagtgatgtttacttcatttttttttttttttttgacaccggcttaagccttctgtgtttcctttgagccttttcactacaaaatcaaatattaatttaactacctttcctccttccccaatgtatcacttttctttatctgagaattcttccaatgaaaataaaatatcagctgtggctgatagaattaagttgtgtccaaaaaaaaaaaaaaaaaa

SEQ ID NO: 52 - DNA, 2525 bp, Homo sapiens
gggaagtcggtgccgctgccgtctctgcgttcgccatgcgtcccggggcgccagggccactctggcctctgccctggggggccctggcttgggccgtgggcttcgtgagctccatgggctcggggaaccccgcgcccggtggtgtttgctggctccagcagggccaggaggccacctgcagcctggtgctccagactgatgtcacccgggccgagtgctgtgcctccggcaacattgacaccgcctggtccaacctcacccacccggggaacaagatcaacctcctcggcttcttgggccttgtccactgccttccctgcaaagattcgtgcgacggcgtggagtgcggcccgggcaaggcgtgccgcatgctggggggccgcccgcgctgcgagtgcgcgcccgactgctcggggctcccggcgcggctgcaggtctgcggctcagacggcgccacctaccgcgacgagtgcgagctgcgcgccgcgcgctgccgcggccacccggacctgagcgtcatgtaccggggccgctgccgcaagtcctgtgagcacgtggtgtgcccgcggccacagtcgtgcgtcgtggaccagacgggcagcgcccactgcgtggtgtgtcgagcggcgccctgccctgtgccctccagccccggccaggagctttgcggcaacaacaacgtcacctacatctcctcgtgccacatgcgccaggccacctgcttcctgggccgctccatcggcgtgcgccacgcgggcagctgcgcaggcacccctgaggagccgccaggtggtgagtctgcagaagaggaagagaacttcgtgtgagcctgcaggacaggcctgggcctggtgcccgaggccccccatcatcccctgttatttattgccacagcagagtctaatttatatgccacggacactccttagagcccggattcggaccacttggggatcccagaacctccctgacgatatcctggaaggactgaggaagggaggcctgggggccggctggtgggtgggatagacctgcgttccggacactgagcgcctgatttagggcccttctctaggatgccccagcccctaccctaagacctattgccggggaggattccacacttccgctcctttggggataaacctattaattattgctactatcaagagggctgggcattctctgctggtaattcctgaagaggcatgactgcttttctcagccccaagcctctagtctgggtgtgtacggagggtctagcctgggtgtgtacggagggtctagcctgggtgagtacggagggtctagcctgggtgagtacggagggtctagcctgggtgagtacggagggtctagcctgggtgtgtatggaggatctagcctgggtgagtatggagggtctagcctgggtgagtatggagggtctagcctgggtgtgtatggagggtctagcctgggtgagtatggagggtctagcctgggtgtgtatggagggtctagcctgggtgagtatggagggtctagcctgggtgtgtacggagggtctagtctgagtgcgtgtggggacctcagaacactgtgaccttagcccagcaagccaggcccttcatgaaggccaagaaggctgccaccattccctgccagcccaagaactccagcttccccactgcctctgtgtgcccctttgcgtcctgtgaaggccattgagaaatgcccagtgtgccccctgggaaagggcacggcctgtgctcctgacacgggctgtgcttggccacagaaccacccagcgtctcccctgctgctgtccacgtcagttcatgaggcaacgtcgcgtggtctcagacgtggagcagccagcggcagctcagagcagggcactgtgtccggcggagccaagtccactctgggggagctctggcggggaccacgggccactgctcacccactggccccgaggggggtgtagacgccaagactcacgcatgtgtgacatccggagtcctggagccgggtgtcccagtggcaccactaggtgcctgctgcctccacagtggggttcacacccagggctccttggtcccccacaacctgccccggccaggcctgcagacccagactccagccagacctgcctcacccaccaatgcagccggggctggcgacaccagccaggtgctggtcttgggccagttctcccacgacggctcaccctcccctccatctgcgttgatgctcagaatcgcctacctgtgcctgcgtgtaaaccacagcctcagaccagctatggggagaggacaacacggaggatatccagcttccccggtctggggtgaggaatgtggggagcttgggcatcctcctccagcctcctccagcccccaggcagtgccttacctgtggtgcccagaaaagtgcccctaggttggtgggtctacaggagcctcagccaggcagcccaccccaccctggggccctgcctcaccaaggaaataaagactcaagccatttaaaaaaaaaaaaaa

SEQ ID NO: 53 - DNA, 3137 bp, Homo sapiens
aaaaccagtattccagatcatttctctccattccaggaagtttgcatagctccctggacttctgctttgcactgccctgcaggagtgggtggggaaaggaagtggctttgaggcacacagaggggcttgttgaggccaccggaggaagcttctgccaccaatatgggacctgtgcccagcctaccagaagagagcatctgaaaacatgtatcgacatggtaacccctctgcttgaagcctcacatggctccctattgccttggtgctgaacaccctatggctgaccgtggcccagcctctgcaacagctctgcctcctctccagtggtgaagacccagcctgctgagactcctcctgcagttcctcaacatgcctgcatttctgctgcctcagggcctttgcgaaggttgttccttgtaactggaatgcccttccatcccttttttattcaaaaggctgcaattttaattgaagaaagttcccttccaaggttcatgagttgcctgacttgcccaccggtttcctgcaagatcccttggcctggcacttagtgctcaggaaatatttggtgatgggccaactgagtgagaaggtgggatctggtgggaaggaaagcggaaaggtagaaattctgctcacttcctcattcccacctcccaaggaacccctggtgtccctgtggaacccgctttgggaaccggtggttcaggtcagccttttcactttgtactcaaagccacatcgcattgaagccacaggtggggcaaggtcatgcatgacctgagtctccaaatcccttcaccctgtttggttctgcaacggggattaggggagccccacgatttgttttcaaaggatgtccgggctccaggacaggatgccctgggtcacctgatgacaggtgtggtggttggaaagggcctggtttcagctccgggtacacttcctccttccttctgctgcgtggtgtggcctcttccacgtcctcagaatccagctgttactccgtccgcggcctctcagctctagggccctctgcacactggcccccccagtgtcacgggcatccagacgggatccagtgcatcctcttttagaagaaaggcctgtctccagatccccgagtccctctagcatctcccagaaggtgtcagacgcagcagtgtccagggagcggcagcagatactctgacccatggatcccctgggcccggccaagccacagtggtcgtggcgctgctgtctgaccacgctgctgtttcagctgctgatggctgtgtgtttcttctcctatctgcgtgtgtctcaagacgatcccactgtgtaccctaatgggtcccgcttcccagacagcacagggacccccgcccactccatccccctgatcctgctgtggacgtggccttttaacaaacccatagctctgccccgctgctcagagatggtgcctggcacggctgactgcaacatcactgccgaccgcaaggtgtatccacaggcagacgcggtcatcgtgcaccaccgagaggtcatgtacaaccccagtgcccagctcccacgctccccgaggcggcaggggcagcgatggatctggttcagcatggagtccccaagccactgctggcagctgaaagccatggacggatacttcaatctcaccatgtcctaccgcagcgactccgacatcttcacgccctacggctggctggagccgtggtccggccagcctgcccacccaccgctcaacctctcggccaagaccgagctggtggcctgggcagtgtccaactgggggccaaactccgccagggtgcgctactaccagagcctgcaggcccatctcaaggtggacgtgtacggacgctcccacaagcccctgccccagggaaccatgatggagacgctgtcccggtacaagttctatctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactcgctttctgcaaggcctgctggaaactgcaggaggaatccaggtaccagacacgcggcatagcggcttggttcacctgagaggctggtgtggggcctgggctgccaggaacctcattttcctggggcctcacctgagtgggggcctcatctacctaaggactcgtttgcctgaagcttcacctgcctgaggactcacctgcctgggacggtcacctgttgcagcttcacctgcctggggattcacctacctgggtcctcactttcctggggcctcacctgctggagtcttcggtggccaggtatgtcccttacctgggatttcacatgctggcttccaggagcgtcccctgcggaagcctggcctgctggggatgtctcctggggactttgcctactggggacctcggctgttggggactttacctgctgggacctgctcccagagaccttccacactgaatctcacctgctaggagcctcacctgctggggacctcaccctggagggcactgggccctgggaactggcacccatggggccccacccatgagtgatggttctggctgatttgtttgtgatgttgttagccgcctgtgaggggtgcagagagataatcaccgcaccgtttccagatgtaatactgcaaagaaaaccgatgatgaggccgggtgcggtggctcacacctgtaatcccagcactttgggaggccgaggcaggcggatcacaaggtcaggagatcgagaccatcctggccaatatggtgaaacccgtctctactaaaaatacaaaaatttgccgggcgtggtggtgcatgcctgtaatcccagctacttgggaagctgaggcaggagaatcgcttgaaccagagagtcggaggttgcagtaagccgagatcgcgccactgcactccagcctggcgacagagcgagactctgtctc

SEQ ID NO: 54 - DNA, 4520 bp, Homo sapiens
ccaggctggtccctcctgccttcgctctctgctggtcgcggtggcctgtagctcctccctcggtaggacccccctccaccttggcgcttacgagatgaatgaggagcccagacctctggaacttggagggttgttcagattcccaggctgacaaaaaggagaaacagcttttacttgcatccagggccaatcatcgcagacccagacgtctgcagagggctgaggccccagcttgtggccaccacaacgtatcaagctatctccagggttgggctcaggactcagagctgacgcagctggggtgccccttggttctggaggatgaggctcctccgcagacgccacatgcccctgcgcctggccatggtgggctgcgcctttgtgctcttcctcttcctcctgcatagggatgtgagcagcagagaggaggccacagagaagccgtggctgaagtccctggtgagccggaaggatcacgtcctggacctcatgctggaggccatgaacaaccttagagattcaatgcccaagctccaaatcagggctccagaagcccagcagactctgttctccataaaccagtcctgcctccctgggttctataccccagctgaactgaagcccttctgggaacggccaccacaggaccccaatgcccctggggcagatggaaaagcatttcagaagagcaagtggacccccctggagacccaggaaaaggaagaaggctataagaagcactgtttcaatgcctttgccagcgaccggatctccctgcagaggtccctggggccagacacccgaccacctgagtgtgtggaccagaagttccggcgctgccccccactggccaccaccagcgtgatcattgtgttccacaacgaagcctggtccacactgctgcgaacagtgtacagcgtcctacacaccacccctgccatcttgctcaaggagatcatactggtggatgatgccagcacagaggagcacctaaaggagaagctggagcagtacgtgaagcagctgcaggtggtgagggtggtgcggcaggaggagcggaaggggctgatcaccgcccggctgctgggggccagcgtggcacaggcggaggtgctcacgttcctggatgcccactgtgagtgcttccacggctggctggagcccctcctggctcgaatcgctgaggacaagacagtggtggtgagcccagacatcgtcaccatcgaccttaatacttttgagttcgccaagcccgtccagaggggcagagtccatagccgaggcaactttgactggagcctgaccttcggctgggaaacacttcctccacatgagaagcagaggcgcaaggatgaaacctaccccatcaaatccccgacgtttgctggtggcctcttctccatctccaagtcctactttgagcacatcggtacctatgataatcagatggagatctggggaggggagaacgtggaaatgtccttccgggtgtggcagtgtgggggccagctggagatcatcccctgctctgtcgtaggccatgtgttccggaccaagagcccccacaccttccccaagggcactagtgtcattgctcgcaatcaagtgcgcctggcagaggtctggatggacagctacaagaagattttctataggagaaatctgcaggcagcaaagatggcccaagagaaatccttcggtgacatttcggaacgactgcagctgagggaacaactgcactgtcacaacttttcctggtacctgcacaatgtctacccagagatgtttgttcctgacctgacgcccaccttctatggtgccatcaagaacctcggcaccaaccaatgcctggatgtgggtgagaacaaccgcggggggaagcccctcatcatgtactcctgccacggccttggcggcaaccagtactttgagtacacaactcagagggaccttcgccacaacatcgcaaagcagctgtgtctacatgtcagcaagggtgctctgggccttgggagctgtcacttcactggcaagaatagccaggtccccaaggacgaggaatgggaattggcccaggatcagctcatcaggaactcaggatctggtacctgcctgacatcccaggacaaaaagccagccatggccccctgcaatcccagtgacccccatcagttgtggctctttgtctaggacccagatcatccccagagagagcccccacaagctcctcaggaaacaggattgctgatgtctgggaacctgatcaccagcttctctggaggccgtaaagatggatttctaaacccactgggtggcaaggcaggaccttcctaatccttgcaacaacattgggcccattttctttccttcacaccgatggaagagaccattaggacatatatttagcctagcgttttcctgttctagaaatagaggctcccaaagtagggaaggcagctgggggagggttcagggcagcaatgctgagttcaagaaaagtacttcaggctgggcacagtggctcatgcctgaaatcctagcactttgggaagacaatgtgggagaatggcttgagcccaggagttcaagaccggcctgagcaacatagtgaggatcccatctctacgcccaccctccccccggcaaaaaaaaaaagctgggtatggtggcttatgcctgtagtcgcagctactcagaaggctgaggtgggaggattgcttgttccccggaggttgaagctacagtgagccttgattgtgtcactgcactccagcctgggcaacaggtaagactctgtctcaaaaaaaaacaaaaaagaagaagaaaagtacttctacagccatgtcctattccttgatcatccaaagcacctgcagagtccagtgaaatgatatattctggctgggcacagtggctcacacctgtaatcctagcactttgggaggccaaggcaggtggatcacctgaggtcagaagtttgaaaccagcctggactacatggtgaaactccatctctactaaaagtacaaaaattagctgggcatgatggcacgcacctgcagtcccagctacttgggaggctgaggcaggagaatcactcgaacccaggaggcagaggttgcagtgagccaagacagcaccattgcaccccagcctgagcaacaagagcgaaactccatctcaggaaaaaaaaaaaaaaaaaaagtatattctaacagacagatcagaggtctaagagatcctcccttgctattattacctgaagtctgtagaactgtttacagatatctccttgacaggtgtcctttatcttactttatctgtacagtaatcctgtgagaaagacaggacagaaaccactgtgcctattttacagatacgaaaactgagacacaggtaaaggggcttgtctgtagtcccatagctagcagatggctggagccaagactgaggctcgttcttcaatgctgagccagggctccttccgctgcaccacaagaacgctagaccactcgccaccagccttctcattccctcttcctccattctaatcatttctagctggctggcctccacagagcataggaaaacagccagggccgggcacggtggctcatgcctgtaatctcaacactctgggaggccgagccgggtggataacctgaggtcaggaattcgagaccagcctggccaacatggtaaaaccccatctctactaaaaatataaaaattagccaggcatggtggcgcacacctgtaatcccagctactcaagaggctgaggcaggagaattgcttaaatctgggaggcggaagttgcagtgagccaagatcgcgccactgaactccagcctaggcaacaagagcaaaactccatctccaaaaaaaagaaaggaaaaacagggccaggtagccattgtggagagagcacacttaggaatcctgggatgttagtgttaaaagaaagctcctggagccagtgattctcaggtttgtcccagaacccttttttctaagccccatataaaaggtagattaaaaaaacaaagtagcatgagtgaaattgagagagggacaggtaatgccttccagcccctaacttctaacaatctggaagcacaacgtgaaaatcacgtagcccaaccctatcattttcatattatgaaactgagtccaggtaagtgaatctgtccaaggtcacccagcaaggtatcagtagccctgagggtaaggactctgataaggctcgggagggtcctggaaagcctgaggcggcaggaagagtgtgcagagttgagcgtgtctggaaggctgatccactgctgggcccacatcaaagcccccatggggagcagacccgactgcacatggctcttttgctggaagaagagcatggctgcgcagaggactaaaatttcatctgggaaggcttcttttgactgtcagtagcaggatgtcaccagatgagggtgctatgggaccacagctgtctttgttcccattgcaactcaaccctgcgg

SEQ ID NO: 55 - DNA, 4540 bp, Homo sapiens
aaactgcgtttaccttaaacaggcttactgtgttcactgctggacgcctctgggcaatcttaccctcctgggaactgagagagacaatgctaggagccagaaacatgaggaatacatgagctcggcgccaatggaacatgctttcacaccgggtgcagctaaccaccacatcatacaaaactcgtcgctgacgttttagatgtataatctgattggcatggactcacagaggagggagtaagggaagagtaagaagatttcaaaggagagacacaggttgcaggttagcaggagaacaggcaagccaaatgcaaaggagccacttcagaaatgtgtcacagaaaagtgaaaatgcaacctagtggtaagtgaagaggggaagaagaaagaaaaaggaccagaaccgtgaactgaagggacagggaacagccagacgagagcttcagccatcacgaggatgatttcggaacctggagaaaatgtaagttaaatatatctacactctgatcctatctcaagagagagatattttactcatttcctggttgtgaatgatgggctcttggaagcactgtctttttagcgcgtctcttatctctgccctgatttttgtatttgtttacaatactgagttatgggagaataaacgttttctgagggcagctctgtccaatgcttcactgttagcagaagcctgtcatcagatttttgaggggaaagttttttacccaacagaaaatgcattgaaaactacccttgatgaagctacctgctatgagtacatggttcgaagccactatgtaacagaaacactctctgaagaagaggctgggttccctttagcttacacagtgaccatccacaaagacttcggcacttttgagaggctcttcagggcgatttatatgccccaaaatgtctactgtgtgcacctggatcagaaggcgacggatgcctttaaaggtgcagtgaaacagttactcagctgcttcccaaatgcttttctggcttccaagaaggagtcggttgtctatggggggatctccaggctccaggctgacctgaactgcctggaagaccttgtggcctctgaagttccctggaagtatgtcatcaacacctgcgggcaagactttcccctgaaaaccaacagggaaatagttcagtatctgaagggatttaaagggaaaaatatcacccccggagtgctgcctcctgaccacgctgttggacggactaaatacgtccaccaagaactgttaaaccacaaaaattcctacgtgattaaaacaacaaaattaaaaactcctcctcctcatgacatggtgatttactttggcacggcctacgtggctctcacaagggactttgctaacttcgtcctccaagaccagctcgcacttgacttactctcctggtccaaggacacctacagccccgacgaacatttctgggtgacactcaacaggattcccggtgttcctggctctatgccaaatgcatcctggactggaaacctcagagctataaagtggagtgacatggaagacagacacggaggctgccacggccactatgtacatggtatttgtatctatggaaacggagacttaaagtggctggttaattcaccaagcctgtttgctaacaagtttgagcttaatacctacccccttactgtggaatgcctagaactgaggcatcgcgaaagaaccctcaatcagagtgaaactgcgatacaacccagctggtatttttgagctattcatgagctactcatgactgaagggaaactgcagctgggaagaggagcctgtttttgtgagagacttttgccttcgtaatgttaaccgtttcaggaccacgtttatagcttcaggacctggctacgtaattatacttaaaatatccactggacactgtgaaatacactaacaggatggctgggtagagcaatctgggcactttggccaattttagtcttgctgtttcttgatgctcacctctatattagtttattgttaggatcaatgataaatttaaatgacctcagatctttgcaccagatactcatcatatacaaatgttttagtaaaaaagagaattgtagataatactgtctaggaaaataagaattaggtttctttgaagaaggaatcttttataacaccttaacagtcaccactgtgctcaaccagacagatagtgaaacagctttctgggtaattcaccaatttcctttaaaacataagctacctgaatggagaatacatcttgtttctgagtttcaacactagcatttttggcttactcatggacaaagttctgtatatagtataaagtcattaacaagaaacaggatatgctttaagacagaattcactgtctgttgcttcagtaaaaggacctcggggaataaaacatttctctcttatatgccagaatgtaggctggtccctatgtcatgtcttccattaagaacactaaaaagtccttgcaagaatggagatatgcattcaagagaggtgctatcacatagatctagtctgaagtctggaacactttcctcttctatgacccctctctccccagtattatcttacttgcaaaatggagaccaaattctatcctgtgaggcttttaattgcaccatagtatgctctgagtagctttacactgcctggtactgatagtagtggctcgatttttaagagccttcaattgtagatgaacatctctgttatttatccctcattcatccatccgttcattcattcagccttcaatcaacatctcttgagtgtctattatgtacaggacatgtactgagacaaaaaggaaacataagagctttttcactctaaaaatcttggcaataatgtcaacaccagaaagcctcctctggagaatcttacagagtgattgtagtttaatacaggaacacacagggctgtgtagcatgataccaggcccaggagatcagtaattacaaattaagggttaaatcagagattattcaacagagagggagaaaggaggagacagagggaggacctgttgtgttccagccattctggtattcctttatgtatctaatttcattcaaacctcacaacagtcttgtgaggcccttatataattactcccattttgcagatgaagtaactgaggcttagaaaggttaatagcaccggggaacaatttctctgggtgagaattgggactctgttgctggtcttctcagttcatttcctgaggtggatttactgagagaaggtgaaataaagccatatttagtataccagagaaggtagattttaagaatggtctcagtgttaatactgagaaaaagtcctgtcagttcagaaaaaatgtgaagtctactttagtattcctgtaatactaaaccgttgagtttctaaatatttatttattctaacaaaaagcaattactacaaatggatgacacatttaatgaacacaattttattttttttctgtaactgtgcttgttgaatgtcaatcatatttaaagggaatgactttgaagtaaaaccttttttcttgctactgaaaaaaatggagttgttttgggtggtaaagtgttaaggaatagggacagctggtcacacaaggaactcttgaaggccacatgtgaaaacctgtcacttgcacagaggccagtcccactaaggtgaccagagtgggctccaagcacaaactgccattggctatagatgggactgtgtccccccaaaattcatgtgttggagccttaaccctcaatgtgatggtatttgagatggggcctttggtaagggaagtttagatgaggtcacgagggtaggaccctcatgatgggatgagtccccttacaagacctctggcttgggccgggcgtggtggctcacacctgtaatcccaacactttgggaggccaaggcaggtagatcacttgatgccaggagttccagaccaggctggccgacatggtgaaaccccatctctactaaaaaatataaaaattagccgggctttgtggcatgtgcctgtaatcccagctatttggcaggctgaggcatgagaatcgcttgaacccaggaggtggaggttacagtgagctgagagtgccccactgcactccagcctgggtgacagagcgagactttgtcccaaaacaaaataggtgaggggatagcgaatgcactcagggtcagcagtggagtttaaaaattgtctcttttcaacttatttaaatgacagcacctgagaagaggaaccgttttacactggatgtttctcatgtagaacaagaaatctttctggaattgatgtttacatgtctgttgttggtcatctctcctgtgtcttaaatactttaatgttggaagagcatagtgtttgggctagtgggtttctgacagcccatgggaatgccctgaaactactgtatctgatgtttgttttcgatgaggttccatgttttgttttcttgggaataaattaatatattgttttccaaaaaaaaaaaaaaaaaaaa

SEQ ID NO: 56 - DNA, 2648 bp, Homo sapiens
aggcaccgccctctctccacccactagaaagccacccgggttctccttcatccccaacgctcctcacctagcccctgtcctgagggtgcccctaaccctggagccagctttaaaggggcaggccccttctcctgccccagccccagccccacccaccgggcccacattctccgtcttccaggtccagcgctccctcacagaactcccccgcaccttgtctcgctcgctccgcccctccttcccagccacagctagaggtcccgggcgcacctgcagagccggaggcttgctggggcatgcgctccatgaaggctctgcagaaggccctgagccgggctggcagtcactgcgggcgaggaggctggggtcacccgagccggagccccctccttggcgggggcgtccggcaccacctcagtgaggccgcggcgcagggcagagagacgccacacagccaccagccgcagcaccaggatcatgattcatcagaaagtggcatgctgtcccgcctgggtgatttgctcttttacactattgctgaaggacaggaacgaatccctatccacaagttcaccactgcactaaaggccactggactgcagacatcagatcctcggctccgagactgcatgagcgagatgcaccgcgtggtccaagagtccagtagtggtggcctcttggaccgagatctcttccgaaagtgtgtgagcagcaacattgtgctcctgacccaggcattccgaaagaagtttgtcattcctgattttgaggagttcacgggccatgtggatcgcatctttgaggatgtcaaagagctcactggaggcaaagtggcagcctacatccctcagctggccaagtcaaacccagacctgtggggtgtctccctgtgcactgtggatggtcaacggcactctgtgggccacacaaagatccccttctgcctgcagtcctgtgtgaagcccctcacctatgccatctccataagcaccctaggcactgactacgtgcacaagtttgtgggcaaagagccaagtggcctgcgctacaacaagctctccctcaatgaggaaggaatcccccataaccccatggtcaatgctggtgccattgttgtcagctccctgatcaagatggactgtaacaaagcagagaagtttgattttgtgttgcagtatctcaacaaaatggctgggaatgaatacatgggtttcagcaatgccacattccagtcagagaaggaaacaggggatcggaattatgccatcggctattatctcaaggaaaagaagtgctttcctaagggggtggacatgatggctgcccttgatctctacttccagctgtgttctgtggaggtcacttgtgaatcaggcagtgtcatggcagccaccctcgccaacggtgggatctgccccatcacaggcgagagtgtgctgagtgctgaagcagtgcgcaacaccctcagcctcatgcattcctgcggcatgtatgacttctctggccagtttgccttccacgtgggcctgccagccaagtcagctgtatcaggagccatcctcctggtggtacccaatgtcatgggaatgatgtgcctgtcacccccattggacaagctggggaacagccatagggggaccagcttctgccagaagttggtgtctctcttcaatttccacaactatgacaacctgaggcactgtgctcggaagttagacccacggcgtgaaggggcagaaattcggaacaagactgtggtcaacctgttatttgctgcctatagtggcgatgtctcagctcttcgaaggtttgccttgtcagccatggatatggaacagaaagactatgactcgcgcacagctctgcatgttgctgcagctgaaggacacatcgaagttgttaaattcctgatcgaggcttgcaaagtgaatccttttgccaaggacaggtggggcaacattcccctggatgatgctgtgcagttcaaccatctggaggtggtcaaactgcttcaagattaccaggactcctacacactctctgaaactcaggctgaggcagcagctgaggccctgtccaaagagaacttagaaagcatggtatgagcacaggtcatggacagcccctgctcaagaaaaagcatgagctggccacacatgtaatccataaccaccaaaaatactatggagagctacactgcttcagtggggaccaagcagtcatttggtgacttaggctagtgctttctatgggagtcaaaataccccattccctcagcagacagagtacagagaagggcctcagaggacacctgcagtacagctatccagagagactgggcttcaaggtacagcctaatggcttgccccactcaaaaccatcccagctcttcacccaggtctcctcttcctctccctgaagaaaccatcatgagagagatactctggtggagggactctagctaccatgcacatgtacatatccacagaatatgggaagtgggaatggctatatacatggctttagtagtctggagaaatctactccccttggccaggacatgctgctgctactgctaacagccaattttatagacagagaaagtattttgtgttcaaataaactttaattaccaaatcatttttgct

SEQ ID NO: 57 - DNA, 2142 bp, Homo sapiens
atggacatatcaatacaaagaaatggaagcatcgttgctgggtatgaagttgttggctccagcagtgcatctgaactgctgtcagccattgaacatgttgccgagaaggctaagacagcccttcacaagctgtttccattagaagacggctctttcagagtgttcggaaaagcccagtgtaatgacattgtctttggatttgggtccaaggatgatgaatataccctgccctgcagcagtggctacaggggaaacatcacagccaagtgtgagtcctctgggtggcaggtcatcagggagacttgtgtgctctctctgcttgaagaactgaacaagaatttcagtatgattgtaggcaatgccactgaggcagctgtgtcatccttcgtgcaaaatctttctgtcatcattcggcaaaacccatcaaccacagtggggaatctggcttcggtggtgtcgattctgagcaatatttcatctctgtcactggccagccatttcagggtgtccaattcaacaatggaggatgtcatcagtatagctgacaatatccttaattcagcctcagtaaccaactggacagtcttactgcgggaagaaaagtatgccagctcacggttactagagacattagaaaacatcagcactctggtgcctccgacagctcttcctctgaatttttctcggaaattcattgactggaaagggattccagtgaacaaaagccaactcaaaaggggttacagctatcagattaaaatgtgtccccaaaatacatctattcccatcagaggccgtgtgttaattgggtcagaccaattccagagatcccttccagaaactattatcagcatggcctcgttgactctggggaacattctacccgtttccaaaaatggaaatgctcaggtcaatggacctgtgatatccacggttattcaaaactattccataaatgaagttttcctatttttttccaagatagagtcaaacctgagccagcctcattgtgtgttttgggatttcagtcatttgcagtggaacgatgcaggctgccacctagtgaatgaaactcaagacatcgtgacgtgccaatgtactcacttgacctccttctccatattgatgtcaccttttgtcccctctacaatcttccccgttgtaaaatggatcacctatgtgggactgggtatctccattggaagtctcattttatgcctgatcatcgaggctttgttttggaagcagattaaaaaaagccaaacctctcacacacgtcgtatttgcatggtgaacatagccctgtccctcttgattgctgatgtctggtttattgttggtgccacagtggacaccacggtgaacccttctggagtctgcacagctgctgtgttctttacacacttcttctacctctctttgttcttctggatgctcatgcttggcatcctgctggcttaccggatcatcctcgtgttccatcacatggcccagcatttgatgatggctgttggattttgcctgggttatgggtgccctctcattatatctgtcattaccattgctgtcacgcaacctagcaatacctacaaaaggaaagatgtgtgttggcttaactggtccaatggaagcaaaccactcctggcttttgttgtccctgcactggctattgtggctgtgaacttcgttgtggtgctgctagttctcacaaagctctggaggccgactgttggggaaagactgagtcgggatgacaaggccaccatcatccgcgtggggaagagcctcctcattctgacccctctgctagggctcacctggggctttggaataggaacaatagtggacagccagaatctggcttggcatgttatttttgctttactcaatgcattccagggattttttatcttatgctttggaatactcttggacagtaagctgcgacaacttctgttcaacaagttgtctgccttaagttcttggaagcaaacagaaaagcaaaactcatcagatttatctgccaaacccaaattctcaaagcctttcaacccactgcaaaacaaaggccattatgcattttctcatactggagattcctccgacaacatcatgctaactcagtttgtctcaaatgaataa

SEQ ID NO: 58 - DNA, 2941 bp, Homo sapiens
cggccgctgcagcagcgcgggccgggccagggggcgcctcgcgcggcagcgactctggcaggcgctgcagtgaagctggacccgcaggcgggcgtgcgtggagcgggggccgcggccgcgccgcagagatgtgactcgggccgaaggccagctggagcgtcggcgctgcggggccgcgggggtcgaatgttcgtggcatcagagagaaagatgagagctcaccaggtgctcaccttcctcctgctcttcgtgatcacctcggtggcctctgaaaacgccagcacatcccgaggctgtgggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcggaggctggtgcggcatggcacgggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtgaaagactttaagttccagagaatcagaatttctcttaccgatttgcctccctggctgtgtctttcttgagggagaaatcggtaacagttgccgaaccaggccgcctcacagccaggaaatttggaaatcctagccaaggggatttcgtgtaaatgtgaacactgacgaactgaaaagctaacaccgactgcccgcccctcccctgccacacacacagacacgtaataccagaccaacctcaatccccgcaaactaaagcaaagctaattgcaaatagtattaggctcactggaaaatgtggctgggaagactgtttcatcctctgggggtagaacagaaccaaattcacagctggtgggccagactggtgttggttggaggtggggggctcccactcttatcacctctccccagcaagtgctggaccccaggtagcctcttggagatgaccgttgcgttgaggacaaatggggactttgccaccggcttgcctggtggtttgcacatttcaggggggtcaggagagttaaggaggttgtgggtgggattccaaggtgaggcccaactgaatcgtggggtgagctttatagccagtagaggtggagggaccctggcatgtgccaaagaagaggccctctgggtgatgaagtgaccatcacatttggaaagtgatcaaccactgttccttctatggggctcttgctctagtgtctatggtgagaacacaggccccgccccttcccttgtagagccatagaaatattctggcttggggcagcagtcccttcttcccttgatcatctcgccctgttcctacacttacgggtgtatctccaaatcctctcccaattttattcccttattcatttcaagagctccaatggggtctccagctgaaagcccctccgggaggcaggttggaaggcaggcaccacggcaggttttccgcgatgatgtcacctagcagggcttcaggggttcccactaggatgcagagatgacctctcgctgcctcacaagcagtgacacctcgggtcctttccgttgctatggtgaaaattcctggatggaatggatcacatgagggtttcttgttgcttttggagggtgtgggggatattttgttttggtttttctgcaggttccatgaaaacagcccttttccaagcccattgtttctgtcatggtttccatctgtcctgagcaagtcattcctttgttatttagcatttcgaacatctcggccattcaaagcccccatgttctctgcactgtttggccagcataacctctagcatcgattcaaagcagagttttaacctgacggcatggaatgtataaatgagggtgggtccttctgcagatactctaatcactacattgctttttctataaaactacccataagcctttaacctttaaagaaaaatgaaaaaggttagtgtttgggggccgggggaggactgaccgcttcataagccagtacgtctgagctgagtatgtttcaataaaccttttgatatttctcaaaaaaaaaaaaaaaa

SEQ ID NO: 59 - DNA, 3806 bp, Homo sapiens
aaactaagccggtttcaagtttcagctcctccttgaattccaggctgctgagacttccctctagaatcctccaacatggagcctcttgcagcttacccgctaaaatgttccgggcccagagcaaaggtatttgcagttttgctgtctatagttctatgcacagtaacgctatttcttctacaactaaaattcctcaaacctaaaatcaacagcttttatgcctttgaagtgaaggatgcaaaaggaagaactgtttctctggaaaagtataaaggcaaagtttcactagttgtaaacgtggccagtgactgccaactcacagacagaaattacttagggctgaaggaactgcacaaagagtttggaccatcccacttcagcgtgttggcttttccctgcaatcagtttggagaatcggagccccgcccaagcaaggaagtagaatcttttgcaagaaaaaactacggagtaactttccccatcttccacaagattaagattctaggatctgaaggagaacctgcatttagatttcttgttgattcttcaaagaaggaaccaaggtggaatttttggaagtatcttgtcaaccctgagggtcaagttgtgaagttctggaagccagaggagcccattgaagtcatcaggcctgacatagcagctctggttagacaagtgatcataaaaaagaaagaggatctatgagaatgccattgcgtttctaatagaacagagaaatgtctccatgagggtttggtctcattttaaacattttttttttggagacagtgtctcactctgtcacccaggctggagtgcagtagtgcgttctcagctcattgcaacctctgcctttttaaacatgctattaaatgtggcaatgaaggatttttttttaatgttatcttgctattaagtggtaatgaatgttcccaggatgaggatgttacccaaagcaaaaatcaagagtagccaaagaatcaacatgaaatatattaactacttcctctgaccatactaaagaattcagaatacacagtgaccaatgtgcctcaatatcttattgttcaacttgacattttctaggactgtacttgatgaaaatgccaacacactagaccactctttggattcaagagcactgtgtatgactgaaatttctggaataactgtaaatggttatgttaatggaataaaacacaaatgttgaaaaatgtaaaatatatatacatagattcaaatccttatatatgtatgcttgttttgtgtacaggattttgttttttctttttaagtacaggttcctagtgttttactataactgtcactatgtatgtaactgacatatataaatagtcatttataaatgaccgtattataacatttgaaaaagtcttcatcattttcagtatttctctctgcattattttttagaagcaactcaaattctgtaatcataatattaccaagtaagtcagtctttatttttgcgtgaaaatcccaagtgtagaaaaaaggacatgagtataagatcatttaacttgattccttataggctgatttgggttgctaatgtattcgtactagattagccacttgggaggaattcaatgctgcatcattctgatagctgaaatagtaaaagtcaactccaaacagcctaaattctagtataaaaagggggtgatcatacaagtcctaaagtgtagatcagcagtcactgaacctcttagagtcacaaggcatttcttctcccaaagtcatgacctttatattttgttagccttataattgactaacaaagcaacctgccaagttggtgaaggttaattattgcctcatgaaatatacattcatcgcataaaagaattaaataggaagatggccaaaaatgtaaaaaagtcgtataaatttgtctaagaagaaaaagacccaatttaagtagtctgtgacttgactcccaaattctgacctgatggatgaaagtgaagatgtttcgtatggcaaattcagtaatgctacctcagtatatagttctgtatacgtatttggaccaaagttattagataaaccaaaaatatttcatgaagcatcttctgcttcagagtccatatccagccacccagctatgaatgtatttagaaagatatttggtggaggtggaatttctaccagaggtcaagaggatttgtagggatagcctcaagaatgccagatgagtgtgtcagaaagcctgctcctacctctcgccagctgcgtgactttaggcaagtcacttaagtaccttatttcagtttcctcacctgtaaattgaacaggggttgaatggaataaaaagccctttgcaactctaaaagtcaattaacacacttactaaggtgttttaagtgaccaggaaggaaatcagaactaacctggattgttagcgaagaaaacagaagccaccaacaagcctatctgtcctttgcaattttgctccaagagcctattagcaatttgaattctgagcctctaagaaaacttatgctcaggtggcccctccaagtgttggtgccagagcactcttgccttgtatcctcacctacgccttccatgaactcatagcagtgctgtggcactgcaggggtgttttatgcattcacgttaggagcatgagcagaactgcatatgccagcaccacatgggcagcagagactccccactgccagatggatgataatggagctgcactgggaacaaccaggactgtcccagtcaacatgatacagatgaacatcctgccttaagtcactagctctctccaaagccagataaagtgggtttcttcacttacatctctctaatcttggctgccttattcaacctacagactctatgtcagtgctggattttctccccttgccctttaggtaagcagagtaggcaggaggagatttgaaagcgtgtcatacatattgccttgaaagaaaggacattcaggtgtcccttcggggttctgtaacaattaggctatgtgtgctgagagagggagcggagtcatttgctgatgtgctgctacctgtaactcaaatgcctcataggaataccagcggacaaacacatagaggaaaagttgaatctttcctatattggacaatcttccttcagtcttgtttctgcatcaaaaagtctgggacacagagtgctacaggatgcctgggctaaggactgtaacagaaaaatatcaacatcagagcctggcacagtggctcacaccggtaatcccagcactttgggaggccgaggcgggtggatcacttcaggtcaggagttcgagaccatcctggccaacatggtgaaacccccatctctactaaaaatacaaaaattagccgggcacggtggcacatgcctgtaatcccagctacctgggaggctgagtcagaagaatcacttgaaaacaggaggctgaggttgcaatgagccaagattgcaccactgcactccaacctgggcaacagagcgagaccccatcttaaagaccctgtctcaaaaaagagagaaaaagaaaaagaaaaatatcaggcatcacatgaaagagtattcagctgtcgttcttgtgaaaaaggaaaaggacaaaatcaaatgcattttaactgtggtaactaattcactgacttgaagtttgctttgtttgttttctttggtgcgtagagaagaatacttcatactaactcctgatcatcttacagcagacataacaacagagtgttagagactggaataaatatgaatttggctgaaatgtgaaaaaaaaaaaaaaaaaa

SEQ ID NO: 60 - DNA, 2710 bp, Homo sapiens
aggagatgtgccaaactgttaagagtggttatttctgagcagaagaatgtggatgaattccattcttcctatttttcttttcaggtctgtgcggctgctaaagaacgacccagtcaacttgcagaaattctcttacactagtgaggatgaggcctggaagacgtacctagaaaacccgttgacagctgccacaaaggccatgatgagagtcaatggagatgatgacagtgttgcggccttgagcttcctctatgattactacatgggtcccaaggagaagcggatattgtcctccagcactgggggcaggaatgaccaaggaaagaggtactaccatggcatggaatatgagacggacctcactccccttgaaagccccacacacctcatgaaattcctgacagagaacgtgtctggaaccccagagtacccagatttgctcaagaagaataacctgatgagcttggagggggccttgcccacccctggcaaggcagctcccctccctgcaggccccagcaagctggaggccggctctgtggacagctacctgttacccaccactgatatgtatgataatggctccctcaactccttgtttgagagcattcatggggtgccgcccacacagcgctggcagccagacagcaccttcaaagatgacccacaggagtcgatgctcttcccagatatcctgaaaacctccccggaacccccatgtccagaggactaccccagcctcaaaagtgactttgaatacaccctgggctcccccaaagccatccacatcaagtcaggcgagtcacccatggcctacctcaacaaaggccagttctaccccgtcaccctgcggaccccagcaggtggcaaaggccttgccttgtcctccaacaaagtcaagagtgtggtgatggttgtcttcgacaatgagaaggtcccagtagagcagctgcgcttctggaagcactggcattcccggcaacccactgccaagcagcgggtcattgacgtggctgactgcaaagaaaacttcaacactgtggagcacattgaggaggtggcctataatgcactgtcctttgtgtggaacgtgaatgaagaggccaaggtgttcatcggcgtaaactgtctgagcacagacttttcctcacaaaagggggtgaagggtgtccccctgaacctgcagattgacacctatgactgtggcttgggcactgagcgcctggtacaccgtgctgtctgccagatcaagatcttctgtgacaagggagctgagaggaagatgcgcgatgacgagcggaagcagttccggaggaaggtcaagtgccctgactccagcaacagtggcgtcaagggctgcctgctgtcgggcttcaggggcaatgagacgacctaccttcggccagagactgacctggagacgccacccgtgctgttcatccccaatgtgcacttctccagcctgcagcgctctggaggggcagccccctcggcaggacccagcagctccaacaggctgcctctgaagcgtacctgctcgcccttcactgaggagtttgagcctctgccctccaagcaggccaaggaaggcgaccttcagagagttctgctgtatgtgcggagggagactgaggaggtgtttgacgcgctcatgttgaagaccccagacctgaaggggctgaggaatgcgatctctgagaagtatgggttccctgaagagaacatttacaaagtctacaagaaatgcaagcgaggaatcttagtcaacatggacaacaacatcattcagcattacagcaaccacgtcgccttcctgctggacatgggggagctggacggcaaaattcagatcatccttaaggagctgtaaggcctctcgagcatccaaaccctcacgacctgcaaggggccagcagggacgtggccccacgccacacacaacctctccacatgcctcagcgctgttacttgaatgccttccctgagggaagaggcccttgagtcacagacccacagacgtcagggccagggagagacctagggggtcccctggcctggatccccatggtatgcttgaatctgctccctgaacttcctgccagtgcctccccgtaccccaaaacaatgtcaccatggttaccacctacccagaagactgttccctcctcccaagacccttgtctgcagtggtgctcctgcaggctgcccgttaagatggtggcggcacacgctccctcccgcagcaccacgccagctggtgcggcccccactctctgtcttccttcaacttcagacaaaggatttctcaacctttggtcagttaacttgaaaactcttgattttcagtgcaaatgacttttaaaagacactatattggagtctctttctcagacttcctcagcgcaggatgtaaatagcactaacgatcgactggaacaaagtgaccgctgtgtaaaactactgccttgccactcactgttgtatacatttcttatttacgattttcatttgttatatatatatataaatatactgtatatatatgcaacattttatatttttcatggatatgtttttatcatttcaaaaaatgtgtatttcacatttcttggactttttttagctgttattcagtgatgcattttgtatactcacgtggtatttagtaataaaaatctatctatgtattacgtcacattaaaaaaaaaaa

SEQ ID NO: 61 - DNA, 2164 bp, Homo sapiens
ataaagcagcctgtcctggcaagggatggtcatcctctcaacctacagacccagtgagccctaggccctcaccccagacccagctgctggataggacccagccccgctcccagagacaatgaccatgtttgaaaatgtcacccgggccctggccagacagctaaaccctcgaggggacctgacaccacttgacagcctcatcgacttcaagcgcttccatcccttctgcctggtgctgaggaagaggaagagcacgctcttctggggggcccggtacgtccgcaccgactacacgctgctggatgtgcttgagcccggcagctcaccttcagacccaacagacactgggaattttggctttaagaatatgctggacacccgagtggagggagatgtggatgtaccaaagacggtgaaggtgaagggaacggcagggctctcgcagaacagcactctggaggtccagacactcagtgtggctcccaaggccctggagaccgtgcaggagaggaagctggcagcagaccacccattcctgaaggagatgcaagatcaaggggagaacctgtatgtggtgatggaggtggtggagacggtgcaggaggtcacactggagcgagccggcaaggcagaggcctgcttctccctccccttcttcgccccattggggctacagggatccataaatcacaaggaggctgtaaccatccccaagggctgcgtcctggcctttcgagtgagacagctgatggtcaaaggcaaagatgagtgggatattccacatatctgcaatgataacatgcaaaccttccctcctggagaaaagtcaggagaggagaaggtcatccttatccaggcatctgatgttggggacgtacacgaaggcttcaggacactaaaagaagaagttcagagagagacccaacaagtggagaagctgagccgagtagggcaaagctccctgctcagctccctcagcaaacttctagggaagaaaaaggagctacaagaccttgagctcgcacttgaaggggctctagacaagggacatgaagtgaccctggaggcactcccaaaagatgtcctgctatcaaaggaggccgtgggcgccatcctctatttcgttggagccctaacagagctaagtgaagcccaacagaagctgctggtgaaatccatggagaaaaagatcctacccgtgcagctaaagctggtggagagcacgatggaacagaacttcctgctggataaagagggtgttttccccctgcaacctgagctgctctcctcccttggggacgaggagctgaccctcacggaggctctagtcgggctgagtggcctggaagtgcagagatcgggcccccaatatatgtgggacccagacaccctccctcgcctctgtgctctttatgcaggcctctctctccttcagcagcttaccaaggcctcctaatttgccttttacgtctgcttcatgactccctaatgccttcccaacctcgtggtgctgtgtccttaccacctaagggcatttcagagccatcagctgaagacatctgaaatctcagctggtcacccatgataaccaacttccacctgcccaaccatatatcaccccctacccctccagctccgcaacccactaagcccatctgctgatgcttaaattttctttacttttcttttctttttttttttttttttgagatggaggctcactctgtcacccaggctggagtgcagtggcttgatcttggctcactgcaacctccgcctcccaggttcaagcaattctcctgcctcagcctctcgagcagctggaattacaggcacgtgccacgacacccagctaatttttgtatttttagtagagacggggtttcaccatgttgcccaggttggtctcgaactcctggcctcaagtgatctgcccgcctcggcctcccaaagtgctgggattacaggcgtgagccaccgtgcccggcctgtgcttaaatattctaggagtagaagcactcagacttttaaaactatgagccgtttcagcaaaactgagaaaaaaagaagattaattaatttcctatcctaatccctcctacttatacttccccaaaaaacaagctttactggaattaatggaaaatattatgtcaatcttagg

SEQ ID NO: 62 - DNA, 2319 bp, Homo sapiens
ttccccactcccccgccctccccagggccctgggaaggggctcagcgtgggaaaggatggttgagttttaaccagaggcaaagcgtgagcgggatcagtgtgtgcggaacgcaagcagccgagagcggagaggcgccgctgtagttaactcctccctgcccgccgcgccgaccctccccaggaacccccagggagccagcatgaagcgagctcaccccgagtacagctcctcggacagcgagctggacgagaccatcgaggtggagaaggagagtgcggacgagaatggaaacttgagttcggctctaggttccatgtccccaactacatcttcccagattttggccagaaaaagacggagaggaataattgagaagcgccgacgagaccggatcaataacagtttgtctgagctgagaaggctggtacccagtgcttttgagaagcagggatctgctaagctagaaaaagccgagatcctgcagatgaccgtggatcacctgaaaatgctgcatacggcaggagggaaaggttactttgacgcgcacgcccttgctatggactatcggagtttgggatttcgggaatgcctggcagaagttgcgcgttatctgagcatcattgaaggactagatgcctctgacccgcttcgagttcgactggtttcgcatctcaacaactacgcttcccagcgggaagccgcgagcggcgcccacgcgggcctcggacacattccctgggggaccgtcttcggacatcacccgcacatcgcgcacccgctgttgctgccccagaacggccacgggaacgcgggcaccacggcctcacccacggaaccgcaccaccagggcaggctgggctcggcacatccggaggcgcctgctttgcgagcgccccctagcggcagcctcggaccggtgctccctgtggtcacctccgcctccaaactgtcgccgcctctgctctcctcagtggcctccctgtcggccttccccttctctttcggctccttccacttactgtctcccaatgcactgagcccttcagcacccacgcaggctgcaaaccttggcaagccctatagaccttgggggacggagatcggagctttttaaagaactgatgtagaatgagggaggggaaagtttaaaatcccagctgggctggactgttgccaacatcaccttaaagtcgtcagtaaaagtaaaaaggaaaaaggtacactttcagataattttttttttaaagactaaaggtttgttggtttacttttatcttttttaatgtttttttcatcatgtcatgtattagcagtttttaaaaactagttgttaaattttgttcaagacattaaattgaaatagtgagtataagccaacactttgtgataggtttgtactgtgcctaatttactttgtaaaccagaatgattccgtttttgcctcaaaatttggggaatcttaacatttagtatttttggtctgtttttctccttgtatagttatggtctgtttttagaattaattttccaaaccactatgcttaatgttaacatgattctgtttgttaatattttgacagattaaggtgttgtataaataatattcttttggggggaggggaactatattgaattttatatttctgagcaaagcgttgacaaatcagatgatcagctttatccaagaaagaagactagtaaattgtctgcctcctatagcagaaaggtgaatgtacaaactgttggtggccctgaatccatctgaccagctgctggtatctgccaggactggcagttctgatttagttaggagagagccgctgataggttaggtctcatttggagtgttggtggaaaggaaactgaaggtaattgaatagaatacgcctgcatttaccagccccagcaacacaaagaatttttaatcacacggatctcaaattcacaaatgttaacatggataagtgatcatggtgtgcgagtggtcaattgagtagtacagtggaaactgttaaatgcataacctaattttcctgggactgccatattttcttttaactggaaatttttatgtgagttttccttttggtgcatggaactgtggttgccaaggtatttaaaagggctttcctgcctccttctctttgatttatttaatttgatttgggctataaaatatcatttttcaggtttattcttttagcaggtgtagttaaacgacctccactgaactgggtttgacctctgttgtactgatgtgttgtgactaaataaaaaagaaagaacaaagtaaaaaaaaaaaaaaaaaaaaaaaaaaa

SEQ ID NO: 63 - DNA, 5711 bp, Homo sapiens
tcactaatgtgcttcaggtatatccctgtctagaagtcagattggggttaaagagtctgtccgtgattgactaacagtcttaaatacttgatttgttgttgttgttgtcctgtttgtttaagaactttacttctttatccaatgaacggagtatcttgtgtcctggaccctttgcaagaacccttcccctagcaacagatgcgtcatctcaaaatatttttctgattggccaaagagtaattgatttgcattttaatggtcagactctattacaccccacattctcttttcttttattcttgtctgttctgcctcactcccgagctctactgactcccaaaagagcgcccaagaagaaaatggccataagtggagtccctgtgctaggatttttcatcatagctgtgctgatgagcgctcaggaatcatgggctatcaaaggtaggtgctgagggaatgaaatctgggacgatagactacgaagcattggagaaaagacctatggacatttggaagataatgtgtggagtgaaagaatagtgtgacaggtattatgtggtctcgacagaaagtataacaaattgtggtttggtggagttcttccctcaccacaaactgaagtaagtcaaatttggtttagagggtcaaaactgagttgtgtattgatgaatagcacggtcctgctacaagccaaactgggggtgggggtgggggtgggggaggaagaatattttctggcaagcattaacaagttatatttctgggctttaattattctttctggaaaattagtaaaattaaaaactaaaaaccacacatagttttgctagaattaaatgaaaaaaaaagttattagccctgttcttatctgaatacatgatacagtagttattttttggagtgtaaatcctgtcggtatatattgagcacatatattgtgttgaagattactagaaggaaaagtcatcaaaaagcaacaatttaccccaggaaaaggggagggaaggcatgctgatatgagttgcctcatgggacagtgatagccattccctgccttcccatctccatggtacagcagatcttatatcatgttaacttagtaatatttccaagagagtagaaaaataagtaaggaaatggggaatctgatattattgtctctcatctccagagcaacattggtgctgttgtaaagatgtactgtagaaaagtattcttcacccagcgtgacccccacagaaggtgtcaggtagacttgaaataagcaaagtaataacccagctcccatacccatagtggcaattgtagatttctattgccccaaaagagccatacatagggatacttacctagaaagacagaggatcttcccttggtttgtgaagaggcagctagtatatttgtgtgtgtttgcatagatgcaaacggtaaataaattcctaggtttatcaatacacagtcaaacattaaaatctctcatcttggctgggcacggtggctcacgcctgtaatcccagcactttgggaggccgaggcgggcggatcacgaggtcaagagatcgagaccgtcctgggcaacatggtgaaaccccgtctctactaaaaatacaaaaaattagctgggtatggtggcacacgcctgtagtcccagctactcgggaggctgaggcaggaggattgcttgagcccgggaggcggaggttgcagtgagctgagatggtgccactgcactccagcctggcgatagagcaagactccgtctcaaacaaccaaaccaaaacaaaacaaaatatctcaccttatctttgaagactaaggaaaaaaaaaatctcccactcatcgatacactccacagaggcagcatactctcccagtgtagctttctcttttcatgttcattattcccttggtgttggttattctcaatgtcaatcgtaacagaacatcttccataataacagtcccaatttaaggagcattaagataaaaggtggaattgccaaggtcaatccagacgagaaccttctcatagaggtaaccaccgtgtgggtttggatgctgggaagcagggggactatgacgctacaaggtctcagtcttaatttttggagtacttcagtccccaggtatattttccatagatttggcccttaaataaaaagaagcttctgactctaaaatgtaaacagtgcttgttacagtcttgttgatatattaagaaattactcaccttatctcatttaatcttaaaaacaaacccctgacaggatcaaaaccacagcaggactacataataggaaaactatacataaataggtagaataatctgctcaggatcactaggtaagttgctgaataagaattcaagatgtttttgatcccagagtttaaaacccaacctttcaaacagtgtttccttcttcttagagtacaatgttctgagaaagagatcctctggaattctggcctaagtgtatttaatgcccgggtaaagaaagtgagagaacatttctctttaggggctgctgctggatttctaaaaagaaaataatttctcagctagtaacatggagccaaacaacagcttcacaagactctgggttctttagccctcatctccttcaatccaccctctttataaccagtccttcttgtttttcccctcccagctttgttcagcagcatgcccttcacccagaccttgtcttgtcactcatccctactcgccatcattctttcattcctcttggcccaatctctctccaccacttcctgcctacatgtatgtaggttattcatttccctctcttgattccccccacccaactctctttctccatttcttgcctttcagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatggtacctccctctctgctgcactcctggacatgggaatccatagtttgaaagtagttgcttcagctctttgtgttagattattgtaactgattttccctccaagggcctaaccttgccattaacaagccccaaattctcatgccagaggtctgagaactttatgggtttgatcctatcttgttgtgctcaagtcttgtctctgtcatccatggtctcctacgaagtcattgccctaagttcatgctaggggagccagaagggaagtccttggatatcttatacctcaatattggctcaatttcttggggagggggtgctgtcagagattgttatctgaggatgtgacatagatttctcagggcacaatttcaactactttttcagctttagggtttttagatacgtttgtaccacaattgagcatgggagggagaggggtgagcctaagcagtgatggctgatttctgtcacgtctgtcatgtgtcccccagtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactggggtatggaccaacactcaatctcctttatttcaaggtttcctcctatgatgcttgtgtgaaactcggtgttctaactgtttcataatatctgctacaattaatataactgtcttctcctactatccagcttcctcctttttttaatctgtaattctctcaatacatcattctgtcttcctcttctttaatctatgaataacttttctctttattaagaaccctacatttgattctgagtgttacttcttcccacactcattaccatgtactctgccttatctccccccagagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgagttaggtgtggtcagaggaagacatatatggagatatctgagggaggaaaacagggtggggaaaggaaatgtaatgcatttaagagacaaggtaggaacagatgtggctcttgatttctctttgctagaatgaatcagacattggtatcatctggtatcccaaagcttcagggtctgtcatccctttctatagacgggcaccttgatcacggctccagtcttagaaatcatctccagtacctaaaaccattgtttcacattagaatactgagtctagggatctagaaaatacattagaatatggagtctagggatctagaaaatactgagtctagggatctagaaaaataagcctcaagatttgggcacatcctagcttgtatttcctggggcaggtcatcagttcagaagcatttccagatcctggctcctttcaggttagggtcaattcattgcatgaaatgggaatctcttagaggccaatgcctgcttttgcttctttagtctcaaatgtagtatgagaaactctaaaaaaaggtaaagcatggttgcttattatgttcagttggagagtaggaactaactgtatacagttagttcatgttggaaaggttagatgaacattgaaagaattttgcaaagtcaaaggattaagagagaagaggaaggaatctgaagcaaggagctcaaaacggatcttaaattccttggtaactatgtgtgtcttgctataggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaatttttggtgtttaagccagttctttgggtggcggtggggggtggggagtcggtcctggggaatatatgtgatcctttcccggtaaaatatctgaatgttgaatttatcttataaattctagaattcatcagacatatcccggttcatttgggcttggtctcattttgtgcatctgcaggcaaccctcttgttgtggtctagtcctcatcaggaaaacctaaagtggggttggtttgttgggagatctcta

SEQ ID NO: 64 - DNA, 5607 bp, Homo sapiens
actcttgtcagggccgcggcacatgggcggccggatgcgctgagcccggcgctgcggggccgcggagcgctggggagcagcggccgccggcgcggggaggggggtggggtgggacggcgcaccgcctccggtgctggcactaggggctggggtcggcgcggtgtcttctgcccttctgcagccgtcgacatttttttttctttctttttttcaattttgaacattttgcaaaacgaggggttcgaggcaggtgagagcatcctgcacgtcgccggggagcccgcgggcacttggcgcgctctcctgggaccgtctgcactggaaacccgaaagtttttttttaatatatatttttatgcagatgtatttataaagatataagtaatttttttcttcccttttctccaccgccttgagagcgagtacttttggcaaaggacggaggaaaagctcagcaacattttagggggcggttgtttctttcttatttctttttttaaggggaaaaaatttgagtgcatcgcgatggagaaaatgtcccgaccgctccccctgaatcccacctttatcccgcctccctacggcgtgctcaggtccctgctggagaacccgctgaagctcccccttcaccacgaagacgcatttagtaaagataaagacaaggaaaagaagctggatgatgagagtaacagcccgacggtcccccagtcggcattcctggggcctaccttatgggacaaaacccttccctatgacggagatactttccagttggaatacatggacctggaggagtttttgtcagaaaatggcattccccccagcccatctcagcatgaccacagccctcaccctcctgggctgcagccagcttcctcggctgccccctcggtcatggacctcagcagccgggcctctgcaccccttcaccctggcatcccatctccgaactgtatgcagagccccatcagaccaggtcagctgttgccagcaaaccgcaatacaccaagtcccattgatcctgacaccatccaggtcccagtgggttatgagccagacccagcagatcttgccctttccagcatccctggccaggaaatgtttgaccctcgcaaacgcaagttctctgaggaagaactgaagccacagcccatgatcaagaaagctcgcaaagtcttcatccctgatgacctgaaggatgacaagtactgggcaaggcgcagaaagaacaacatggcagccaagcgctcccgcgacgcccggaggctgaaagagaaccagatcgccatccgggcctcgttcctggagaaggagaactcggccctccgccaggaggtggctgacttgaggaaggagctgggcaaatgcaagaacatacttgccaagtatgaggccaggcacgggcccctgtaggatggcatttttgcaggctggctttggaatagatggacagtttgtttcctgtctgatagcaccacacgcaaaccaacctttctgacatcagcactttaccagaggcataaacacaactgactcccattttggtgtgcatctgtgtgtgtgtgcgtgtatatgtgcttgtgctcatgtgtgtggtcagcggtatgtgcgtgtgcgtgttcctttgctcttgccattttaaggtagccctctcatcgtcttttagttccaacaaagaaaggtgccatgtctttactagactgaggagccctctcgcgggtctcccatcccctccctccttcactcctgcctcctcagctttgcttcatgttcgagcttacctactcttccaggactctctgcttggattcactaaaaagggccctggtaaaatagtggatctcagtttttaagagtacaagctcttgtttctgtttagtccgtaagttaccatgctaatgaggtgcacacaataacttagcactactccgcagctctagtcctttataagttgctttcctcttactttcagttttggtgataatcgtcttcaaattaaagtgctgtttagatttattagatcccatatttacttactgctatctactaagtttccttttaattctaccaaccccagataagtaagagtactattaatagaacacagagtgtgtttttgcactgtctgtacctaaagcaataatcctattgtacgctagagcatgctgcctgagtattactagtggacgtaggatattttccctacctaagaatttcactgtcttttaaaaaacaaaaagtaaagtaatgcatttgagcatggccagactattccctaggacaaggaagcagagggaaatgggaggtctaaggatgaggggttaatttatcagtacatgagccaaaaactgcgtcttggattagcctttgacattgatgtgttcggttttgttgttccccttccctcacaccctgcctcgcccccacttttctagttaactttttccatatccctcttgacattcaaaacagttacttaagattcagttttcccactttttggtaatatatatatttttgtgaattatactttgttgtttttaaaaagaaaatcagttgattaagttaataagttgatgttttctaaggccctttttcctagtggtgtcatttttgaatgcctcataaattaatgattctgaagcttatgtttcttattctctgtttgcttttgaacgtatgtgctcttataaagtggacttctgaaaaatgaatgtaaaagacactggtgtatctcagaaggggatggtgttgtcacaaactgtggttaatccaatcaatttaaatgtttactatagaccaaaaggagagattattaaatcgtttaatgtttatacagagtaattataggaagttcttttttgtacagtatttttcagatataaatactgacaatgtattttggaagacatatattatatatagaaaagaggagaggaaaactattccatgttttaaaattatatagcaaagatatatattcaccaatgttgtacagagaagaagtgcttgggggtttttgaagtctttaatattttaagccctatcactgacacatcagcatgttttctgctttaaattaaaattttatgacagtatcgaggcttgtgatgacgaatcctgctctaaaatacacaaggagctttcttgtttcttattaggcctcagaaagaagtcagttaacgtcacccaaaagcacaaaatggattttagtcaaatatttattggatgatacagtgttttttaggaaaagcatctgccacaaaaatgttcacttcgaaattctgagttcctggaatggcacgttgctgccagtgccccagacagttcttttctaccctgcgggcccgcacgttttatgaggttgatatcggtgctatgtgtttggtttataatttgatagatgtttgactttaaagatgattgttcttttgtttcattaagttgtaaaatgtcaagaaattctgctgttacgacaaagaaacattttacgctagattaaaatatcctttcatcaatgggattttctagtttcctgccttcagagtatctaatcctttaatgatctggtggtctcctcgtcaatccatcagcaatgcttctctcatagtgtcatagacttgggaaacccaaccagtaggatatttctacaaggtgttcattttgtcacaagctgtagataacagcaagagatgggggtgtattggaattgcaatacattgttcaggtgaataataaaatcaaaaacttttgcaatcttaagcagagataaataaaagatagcaatatgagacacaggtggacgtagagttggcctttttacaggcaaagaggcgaattgtagaattgttagatggcaatagtcattaaaaacatagaaaaatgatgtctttaagtggagaattgtggaaggattgtaacatggaccatccaaatttatggccgtatcaaatggtagctgaaaaaactatatttgagcactggtctctcttggaattagatgtttatatcaaatgagcatctcaaatgttttctgcagaaaaaaataaaaagattctaataaaatgtattctcttgtgtgccaggagaggtttcagaaacctacctcgtcttacaaatttaaacactttggagtctgtacaggtgccttatatgtaggtcattgtcacgatacacacacacgaacactccctctggactggctgcctctccatccagggcagttaactagcaaacaaggcagatctgcttcatggagcgggaggccatggcttgactctgagtgatttgggtcaaccggagtcagacgcatgtctgcacgctgcagctattatgagagtccctttgtcatttttcaccttttcatcctaagcatctttcagagattaattatttggccattaacaatgaatccaaatcatatcatactgacatcatctagacatgatttggaaggaacagcttaggacctcctgatgaggtcacattgttgtttcttttaactagacttggcaaagaaaggcaaaaattgaccagcctatctttctgctggtgctgccttaaggaggtagtttgttgaggggagggctgtagatcattacttctttctcttcaggaagtggccactttgaaccattcaaataccacattaggcaagactgtgataggccttttgtcttcaaatacaacaggcctccactgacccatccctcaaagcagaaggaccctttgaggagagtacagatgggattccacagtggggtgggtggaatggaaacctgtactagaccacccagaggttccttctaacccactggtttggtggggaactcacagtaattccaaatgtacaatcagatgtctagggtctgttttcggaagaagcaagaattatcagtggcaccctccccactgcccccagtgtaaaacaatagacattctgtgaaatgcaaagctattctttggtttttctagtagtttatctcattttaccctattcttcctttaaggaaaactcaatctttatcacagtcaattagagcgatcccaaggcatgggaccaggcctgcttgcctatgtgtgatggcaattggagatctggatttagcactggggtctcagcaccctgcaggtgtctgagactaagtgatctgccctccaggtggcgatcaccttctgctcctaggtacccccactggcaaggccaaggtctcctccacgttttttctgcaattaataatgtcatttaaaaaatgagcaaagccttatccgaatcggatatagcaactaaagtcaatacattttgcaggaggctaagtgtaagagtgtgtgtgtgtgtgtgtgcgtgcatgtgtgtgtgtgtgtatgtgtgtgaataagtcgacataaagtctttaattttgagcaccttaccaaacataacaataatccattatccttttggcaacaccacaaagatcgcatctgttaaacaggtacaagttgacatgaggttagtttaattgtacaccatgatattggtggtatttatgctgttaagtccaaacctttatctgtctgttattcttaatgttgaataaactttgaattttttcctttcaaaaaaaa

SEQ ID NO: 65 - DNA, 9443 bp, Homo sapiens
gggcttggcttggagggggcaagggagggaaagagagaagggggaaacacaaaaaacttctttctttctccctccgtttatcttcagcccgacattgtcacctcctctttgaggggttagaagaagctgagatctcccgacagagctggaaatgcattgcactttgactatggaaacagaggctattgatggctatataacgtgtgacaatgagctttcacccgaaagggagcactccaatatggcaattgacctcacctcaagcacacccaatggacagcatgcctcaccaagtcacatgacaagcacaaattcagtaaagctagaaatgcagagtgatgaagagtgtgacaggaaacccctgagccgtgaagatgagatcaggggccatgatgagggtagcagcctagaagaacccctaattgagagcagcgaggtggctgacaacaggaaagtccaggagcttcaaggcgagggaggaatccggcttccgaatggtaaactgaaatgtgacgtctgtggcatggtttgcattgggcccaatgtgcttatggtacataaaaggagtcacactggtgaacgccccttccactgtaaccagtgtggagcttcttttactcagaagggcaaccttctgagacacataaagttacactctggagagaagccgttcaaatgtcctttctgtagctacgcctgtagaagaagggacgccctcacaggacacctcaggacccattctgtgggtaaacctcacaagtgcaactactgtggacgaagctacaagcagcgcagttcactggaggagcacaaggaacgctgccacaactatctccagaatgtcagcatggaggctgctgggcaggtcatgagtcaccatgtacctcctatggaagattgtaaggaacaagagcctattatggacaacaatatttctctggtgccttttgagagacctgctgtcatagagaagctcacggggaatatgggaaaacgtaaaagctccactccacaaaagtttgtgggggaaaagctcatgcgattcagctacccagatattcactttgatatgaacttaacatatgagaaggaggctgagctgatgcagtctcatatgatggaccaagccatcaacaatgcaatcacctaccttggagctgaggcccttcaccctctgatgcagcacccgccaagcacaatcgctgaagtggccccagttataagctcagcttattctcaggtctatcatccaaataggatagaaagacccattagcagggaaactgctgatagtcatgaaaacaacatggatggccccatctctctcatcagaccaaagagtcgaccccaggaaagagaggcctctcccagcaatagctgcctggattccactgactcagaaagcagccatgatgaccaccagtcctaccaaggacaccctgccttaaatcccaagaggaaacaaagcccagcttacatgaaggaggatgtcaaagctttggatactaccaaggctcctaagggctctctgaaggacatctacaaggtcttcaatggagaaggagaacagattagggccttcaagtgtgagcactgccgagtccttttcctagaccatgtcatgtacaccattcacatgggttgccatggctaccgggacccactggaatgcaacatctgtggctacagaagccaggaccgttatgagttttcatcacacattgttcgaggggagcacacattccactaggccttttcattccaaaggggacccctatgaagtaaagaactgcacatgaagaaatactgcacttacaatcccacctttcctcaaatgttgacataccttttattttttttaatattattactgttgataattcttattttgtggaggcagtgtcatttgctctgcctaattacgataaggaagaaacagaagagagaaggggcgggaatattgtttctttatcacctggcttgtttattttgtgggaatttaagagcagtccatttctaccaaggcatatcatgctttgaaaaatcacttgattcataaagattcacctaagagattctgatttgccactgatattcagaattatgatggaagacaggaaagttcagagttttctgggtaggactttggtggtttaaaaatggtataagtaactttattcttgaaagaagaatgtgtttcaaactgtaaaccaattttttgttcttcagagatcatggaacacaaacacattgttattttcagtgataactcctaagaggagctgagttgttgtgggttctatgtttacttcccctatggaatttataattcagtatgttttacactgtaccatatagcaaaacttttaaactacaggtagttaagggccacctacaatacatctgaggtcctgtgatcttatttttctaaacgtaagcactgtttttccatagttttgatgactggcattttatagacaccctggcagccttacttttaacacctttaaggaatagtatttttatgtagttttcagaataacatatggtctaagagtggataaaaggcagtcaataatttctgggagggacttctactttcataaatttgtttgagaggttttcttttaaagttgtaatgtgatggcagcatagtatatgtatttgtttctaaaagtatgcttacgattgtcactttatcagcatttaatcagtgttaaccagtcagcagaaaaatataattatgctaacagtagggggagaaaacccacttagaaatcccttttctggtatttctcttttcactagtttttttcaagatgtgacctcccggtgttctgtccatagttcattcatcctttactcttcgagtagaaggtcttaaaagtcttcctgtcggctgtttctttcaaaatctcctcagagcaattgctaatttggcctgaatctggtaacttgaaccctgtaaggttacagaactagggctatttattttagcatttcttcagtagtatttactactcttgttgcaaagaaaagggaatgggacttctttgtaacctgtaccttggacaacagataaaagaaacaaaaaaataagaaagtttacttttacccttcttggagtctagaatgtgacagaacccccaaaggaaagtcctgcacatttttctgtttccaaaacatttaattgtgtaagtccttgtcagaaatgaatctcaatcccttagtatagaattccccttacatggtataggttgccatatttcatgtgcagattttaatttcatttatgtgggcgctctgttttttctttgcagtccagccacattagaggggaggaaccgagtgatattgattcaagtcattttagggggacatacttggaaggcagaacttgctgcttctgtttggggaggacagacctgactgtgactggattatctgataaccatttgtgaatactgaaattctgttaggcagtaactgataactgctctaaaggatcattaaataggatgctgaaattatgtatcttaatacagtgtggtatgagaattaccaagtcaagagaattgtggacataagcaagtttggccccaatactgctcttaactcattttccagcttactatttgctatttaaatggtaggcaccagctaagcacttctaagcactaacacagctagaactaggcaaaaatggttagaactcagctctcttctactagtccctgtcataattatttttgggaaaatgtccaaactgccccctttaaatctaagggaatgcaccaaaacagagatatatagaatgtcaaccatttcatttttttttttctgcatgccttggtacatagtgaacatacaacctatttaaagataaagcatgtttttgagactcgctcacccccccccacccaaccactcccaaataataattgggatgccattttttttccttttggatgaggtaaataattttaaggttcacaattttgtcttttactgcaatttaaggaaacatttggatgtcagtcaatatgttcataattttggctgtgtgcgaatttctgctggcattatctatgaattttcttcctacttatttttttttcagtatatgaacaatcatgtatctacctgccccaggatgaaactaaatttaggtggaccctaaaccttatgaagacagtgctgaggcactttccttttctgatttcatctttttgggaatctgttttattgaaggtagttagtagttgagagtgcatttgctacaagcatatacttgtatcttcctagcttcatgaggaacagaaagaggtggatatggctcagggtgtggcagggacaattgaggacaaagtcaattcaaatttgtgggtcagaaagaatttttgtggacgtagtgtttttggagaaactctggatggttatatgtgcatgccttttcttcaaaaggaaatacgcaaggttgtagcatctaaaaataaacataagagtcagacaccaaataaatcaagttttacataacagttgtatgcccagtttgtttaggtgagatttcacattacagaaagtatttgaggagcatgaaaatgggttatcttctgtattttccagtttggcaaaagttcagaatttcatcacattgctttgccctaattttgcccagaattttatcttagcctctctctgacagtgatgaatcatgctcaaaagccattctaattggacctttttaagacagggaaagggatcagtaggcggattggaagaaatttcaagtcattgaaatattccattgagatttcctaaagggacaaaattgggaaaataagaaactacgacttagatttggctacgtagtagaaagtatctcccctacatacatacaggcaattgtatgtatgaatcatagggtatatgtgtgtgtatactacacacacattcttttaaagagaattcatggaaaaaaaagcagttggagtgatcagatgtattgcaaaaacatacagagaatttaaatgacagttaataccaagaaattagttgggtttactttatcaggtcgtaataggaatcactaaagaagttactagtgtgtctttaggaccagtggcaactcttaaactaaaactttgggtccttattatctacttacagaacaaagtgaaacaaacaatgattaagctgattggatatacattcaaagatatttaatgtaaagttttttggaatacgaagaaaattcagaaaataaatattatcaacagttacttattggcaaatagagaaagacaagaatagtttagtgagcccggtattttgtttttatagtttttatctcagttgtacaactcacaaaaccatgaagtctttggtattttataaatgtttaacaaaatttacatcagattaaggcatttagatgaaaattattatgttctcactatcttccaaattttatttcatcctatctccaaaatgatttcttagggtacaaaaagagcagacggggctgtaaaaatacaagcaaaaaactgtgtgcccctagtttcaggcagaacttaaactgtcagaggtactagctacatgatttgttttttaactttggattgttcacgtccaaaaatggataaattacatttgtgtttatcatcagttgcattttatgtattattttaataaatactatctgaatgaagactattctaaaccagaaaattccccaaatccaaaagaaaaaaaaagtgggaagaggtgaaattgaagtttgtgtatatgaaagttatcttagacatatttttaattctccagtttctgcaaaataattaaaatatacagtaactggtctcctaaatcctgaatttaatgtattaaatacttatgttctttatattggtgcctttttaaaatgcattgagagtgttggttagctgttgcagctgtacaacacttttaatatgcatttttaaaaatcacttaaaattgagtactatataattcatctctgcatttttagtgcaaatctttagagcaatttctaatagagaaattttcagctcagctgttaaaaggaaaaggaaactttgaaactagactttactacctttttagtttcatagtatttctgaatatgattacaagattatgcaggtaaaatatagagtgaaactttacctgtgaattgaattataatttgtgtttttgttttgtttttaaggaagaataagttctgtatcaaacaagaatttattagataattttttggtcaataaaatacagtattcatttggattttcatctccagactagtattgttctagtcttggaatctgtattttctaatctgttagaaaatagagattgaaaattgatggaataatgtgaaaaagcaggtaattaattctccttgaacaaagcaaaactgaacagtcatatcacattgctattctccaaagcataatctcaaatggtttcatatcatggttgtgtattacttgcaatgggtgtgttaggatatgacagctttttaaaaaaatgagctgctggttatacaaagcaaatggcatatgaccaagaagctgtgatatgctagtgtttctttttatcatagtgtattactaggccaaataatgacaccttgaatatttttacatttattgcagaaaccttaaactttggaatttccataaggtttttatgtaatattctatttctagctttttagttttatcttgctgtactgtaagtttgaggatatttttcacctgcactcttaggaataagttcataattctgtttatggggctttcctcccataacactgcatttgtatattttctgtataaaatatgtgttgtgtattaacctttatcccatacagagagtggtacatgaatgactagttttctaagatgtcctttttattgtgaataaaatataaaagttaaaggccctctgctaagtcacataaagtacagcatataagttcatataggtacaaataaatgagtttgcagtgaattgggccttcaaattacctcaagtgacagatagtaagaaaagcttcttgagcaggtggaggtcactgaatcccctactatgcacttaccaagattttacttactttaatttactggaaattgattttttaaaaaatgactacactgtaacaagggaagggatctgggtttttttgttgttttattcttgttttttttaagtagttcaaattctgaaactgtgatttaaaaattttttacagtcaagcattctgattttgaacataactcccttccctttctgtgtaacaaaggtctctctgttatctcttaaattttgttacatctccctcagcctctttctttgtccgtctcccttctgtcattgtctatggatgtttacctctctgttctcctaaaagtttgaagattaggtcaactcttatttctagttcattggtaatttaatcttaatttttttttcgtgatttttgttggttgtataatctgctgacgtatttttatactcaagtgtagttttctattaaaaagaaaagtggttggattaaaaatagtaagctatgtaaccctcatgttactttcactttcaaatattgggtacctaaaacattacttcagagattatgtaatcctattatagtatgtttgctttcctttattgttggattttacattctgatttggctttcctccaaaaaatgtatatcatgaaagactagacagttatttgcaagtgtttagaaaggtgttaaaaatgtaaagcaaagagtcttaactttctcctaattgggagaaaaatgctttaacattactataataatattccaggtttggagggggtctccaggccccatatttgctgttaatagttggaccttttagaccatgtgttatttgcaatcccagaatgattgcttctgctattagttaaaaagatactattcttttctttctgtacaagtgcaatactccccttgaagtcttaaaaactatggtgatttttttttcttttctgacctattcttcctttagctaatgacaaaaagaaactcataaaagtcatagtatgttaaaggacacaacaagcaaagagaaaaacactccacaatcaaaagattacagaatgtggaaaccactagtctgatctcatggtatctttatttaagctaaatttccatggaaattagtaatcttttgcttgaaaaatgtgtcctaaagttgaactttttacagattgaatcttcttagaccctcgcccaatgctctaaattaagaacctaatacttaatatttttattttacttctccccttttagaaataaacttttaaataaaagcaaagcacttagctgagttttaaacacttacatatcacctattggagaaattttttttaaaaatatttggagcagtcctgttttcatacaaatttaagtaagaggtatttttcttatacatatttatatgtagtgtgctaattttctttttttatacctgtgtccctgtagtaaaactgctgtaatataaatacatgttttgttaaaagataacatttctttggcatttcttttaaaggcagttactgcatttctgcatttgtacagtatgtgtcttggccattttagatattctttctttaacaataccaaaggtaattagactattttaaagactaattgcttgacagtttctagggtattttgtgttttagaagcaaaaaaagaaaaaaaaataggtcaaaccagtaaacctcattttttttcaaactaataatttggggaaataaaaactattgtttaaaaaagaaatatatatatatatatataaatatatatgtaaagttaaaattccataccttgtatgtcaggtttgctaagtgtaatgtagtttttttaaggctcaaataccatacctcagaaaatgaggtttactatggaaatactgaaacagtctttgcagctgtgtgacaagtcactctactacatactgatttggagacctccgctaaatagttttatcactgcagactaaaatgtgggacttgtatcttctttgtttttaatgcacacacatacatgttctgtgcatgtatgtggttactgtgtatatgtgtatgagtgttgtatatgcatgtgtgagtgtgtgtctgtatgtgtgtacaactaaagaagctgcagaaactttgtaatactttgtgaaaaggattatattataaaggtttgtactgtctgagtgcacagctactggaataaatttagggaatctcaggaacaagcatataatttgtccaagatttatttcttctcagaagtgtaagtgcagtttttaattctgtatattatttaatattttaccaataaaataaacttctgacataaaaagtttgctataaaaaaaaaaaaaaaaaaaaaa

SEQ ID NO: 66 - DNA, 3710 bp, Homo sapiens
gggtctccgcgcccaggaaagccccgcgcggcgcgggccagggaagggccacccaggggtcccccacttcccgcttgggcgcccggacggcgaatggagcaggggcgcgcagataattaaagatttacacacagctggaagaaatcatagagaagccgggcgtggtggctcatgcctataatcccagcacttttggaggctgaggcgggcagatcacttgagatcaggagttcgagaccagcctggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacgtggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctatgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctctttaaaaaaaaaaaaaaaaaaaaaa

SEQ ID NO: 67 - DNA, 6105 bp, Homo sapiens
agtacagtataaaacttcacagtgccaataccatgaagaggagctcagacagctcttaccacatgatacaagagccggctggtggaagagtggggaccagaaagagaatttgctgaagaggagaaggaaaaaaaaaacaccaaaaaaaaaaataaaaaaatccacacacacaaaaaaacctgcgcgtgaggggggaggaaaagcagggccttttaaaaaggcaatcacaacaacttttgctgccaggatgcccttgctttggctgagaggatttctgttggcaagttgctggattatagtgaggagttcccccaccccaggatccgaggggcacagcgcggcccccgactgtccgtcctgtgcgctggccgccctcccaaaggatgtacccaactctcagccagagatggtggaggccgtcaagaagcacattttaaacatgctgcacttgaagaagagacccgatgtcacccagccggtacccaaggcggcgcttctgaacgcgatcagaaagcttcatgtgggcaaagtcggggagaacgggtatgtggagatagaggatgacattggaaggagggcagaaatgaatgaacttatggagcagacctcggagatcatcacgtttgccgagtcaggaacagccaggaagacgctgcacttcgagatttccaaggaaggcagtgacctgtcagtggtggagcgtgcagaagtctggctcttcctaaaagtccccaaggccaacaggaccaggaccaaagtcaccatccgcctcttccagcagcagaagcacccgcagggcagcttggacacaggggaagaggccgaggaagtgggcttaaagggggagaggagtgaactgttgctctctgaaaaagtagtagacgctcggaagagcacctggcatgtcttccctgtctccagcagcatccagcggttgctggaccagggcaagagctccctggacgttcggattgcctgtgagcagtgccaggagagtggcgccagcttggttctcctgggcaagaagaagaagaaagaagaggagggggaagggaaaaagaagggcggaggtgaaggtggggcaggagcagatgaggaaaaggagcagtcgcacagacctttcctcatgctgcaggcccggcagtctgaagaccaccctcatcgccggcgtcggcggggcttggagtgtgatggcaaggtcaacatctgctgtaagaaacagttctttgtcagtttcaaggacatcggctggaatgactggatcattgctccctctggctatcatgccaactactgcgagggtgagtgcccgagccatatagcaggcacgtccgggtcctcactgtccttccactcaacagtcatcaaccactaccgcatgcggggccatagcccctttgccaacctcaaatcgtgctgtgtgcccaccaagctgagacccatgtccatgttgtactatgatgatggtcaaaacatcatcaaaaaggacattcagaacatgatcgtggaggagtgtgggtgctcatagagttgcccagcccagggggaaagggagcaagagttgtccagagaagacagtggcaaaatgaagaaatttttaaggtttctgagttaaccagaaaaatagaaattaaaaacaaaacaaaaaaaaaaacaaaaaaaaacaaaagtaaattaaaaacaaaacctgatgaaacagatgaaggaagatgtggaaaaaatccttagccagggctcagagatgaagcagtgaaagagacaggaattgggagggaaagggagaatggtgtaccctttatttcttctgaaatcacactgatgacatcagttgtttaaacggggtattgtcctttccccccttgaggttcccttgtgagccttgaatcaaccaatctagtctgcagtagtgtggactagaacaacccaaatagcatctagaaagccatgagtttgaaagggcccatcacaggcactttcctacccaattacccaggtcataaggtatgtctgtgtgacacttatctctgtgtatatcagcatacacacacacacacacacacacacacacacacacaggcatttccacacattacatatatacacatactggtaaaagaacaatcgtgtgcaggtggtcacacttcctttttctgtaccacttttgcaacaaaacaaaacaaacaacattaaaaaattgagaacaagtatggaaagaatgaaagatcaaggaaaaaagaataccaagttacatttcgttaaggtgcttatgatcttagaactatgcaacctaataggtttgaaactgtttacctgagagagaacaaaaagagagacttttttgtattggaagtaatctgattaatttttattttcttcaaggagagatacttgaaaggaatatgtttgtccatctgttggatccaaacatttctatattttgtaaatgttgttgttgttttttttttaatcgtttactatttgcactacaatggtgtttgacctgtctaatccttatttaacaagtattttctttggttgggggtgggggtggggtttaagagctgcacttaatgtgagctataaaagaactgctacagcacacaaaatagctatttttattattataattataattattattattattttgtaccttaaaaaatagacacatacaccaaagacatttgtgtgagcctttaaacagtctgtctgtggttggtatcattcaccatcaatgagtcaggggttgggattcaaggttgagtagtgtggattgtgttcaggcttaaaagacctgagaagtttggtttttgactccttttacatccatgaaacaggacatttcatactggatgtacagtagttgtacactgttggatatcaagttcaatcaaattcatggaactacatgcttgtatgtgtatatatacattgcttgtgcatatgcatatctgtatgtatatatacatgtattgtaccatgtccatacacattttaagcacttcaggctgtcattttttaatgttcttaaagcaatgaatgtttgtgtgcaaaacacagtatttttaagaaggataggctatagtttttgcttttactctgaactaggtgggcgcatttcaaaaattcggatgggaaaaagcctggaaattccagtgaatattcagcaaggccctctttcattgtacagggatcaaatttcctcctcttttttgtgccccctcccacttctacaagttatcccctgtggggaaaacaggatgataatcaaaactctgggctgatgtttttccaacttagtgtctattggaatcaatcttaaatcagaagctttttcagaaaaataatatttaggccagaattagagttgagtgtattttttaaaaatgattaaggcttggttgtgagaaatattacctgtaccagctgggaaaaataatgtcatcactaactaaaagataattaatttgagagaaagtgttaagagagggagagtaaggaagagaacagttaagaggaggcagaggtgagggcagtagtaaaaatctctaaaattttaatttacagccaaaattcttcatgtgtaaatttgtattgattcagatgcagaaatgaaaaaaaaacacctttgttttataaatatcaaagtacatgcttaaagccaagtttttatctagtttattctagtacttagcttgcctggaatagctaataaattattcatgtatgtgcttttgaaaatccagagccctatttttacacacttgtgtgaagttggcaaacattttgaaaaatggaaaaaagtttctaataattgggaacaattacattaattaatattttgtaaaatattgaagcttttagccctatgtcaatttgtagattaaaataaattaattataggaaaggaagataacagtgagaaaccaaacattacaaaaggtggtttagctctccttgaaaaatatactaagttggtatactataacacttggctatatgtaggcaatgtcactactgggcaaatacacttactgtgttctagaggcagccctttcttatgcagaaaatacaatacgcactgcatgagaagcttgagagtggattctaatccaggtctgtcgaccttggatatcatgcatgtgggaaggtgggtgtggtgagaaaagttttaaggcaagagtagatggccatgttcaactttacaaaatttcttggaaaactggcagtattttgaactgcatcttctttggtaccggaacctgcagaaacagtgtgagaaattaagtcctggttcactgcgcagtagcaaagatggtcaaggccatggaaaaagcagaaatttaccaagaaagctgatacccatgtatagttcccactcatctcaaatacatctgctatctttttaagctaagtcctagacatatcggggataacatgggggttgattagtgaccacagttatcagaagcagagaaatgtaattccatattttatttgaaacttattccatattttaattggatattgagtgattgggttatcaaacacccacaaactttaattttgttaaatttatatggctttgaaatagaagtataagttgctaccattttttgataacattgaaagatagtattttaccatctttaatcatcttggaaaatacaagtcctgtgaacaaccactctttcacctagcagcatgaggccaaaagtaaaggctttaaattataacatatgggattcttagtagtatgtttttttcttgaaactcagtggctctatctaaccttactatctcctcactctttctctaagactaaactctaggctcttaaaaatctgcccacaccaatcttagaagctctgaaaagaatttgtctttaaatatcttttaatagtaacatgtattttatggaccaaattgacattttcgactattttttccaaaaaagtcaggtgaatttcagcacactgagttgggaatttcttatcccagaagaccaaccaatttcatatttatttaagattgattccatactccgttttcaaggagaatccctgcagtctccttaaaggtagaacaaatactttctatttttttttcaccattgtgggattggactttaagaggtgactctaaaaaaacagagaacaaatatgtctcagttgtattaagcacggacccatattatcatattcacttaaaaaaatgatttcctgtgcaccttttggcaacttctcttttcaatgtagggaaaaacttagtcaccctgaaaacccacaaaataaataaaacttgtagatgtgggcagaaggtttgggggtggacattgtatgtgtttaaattaaaccctgtatcactgagaagctgttgtatgggtcagagaaaatgaatgcttagaagctgttcacatcttcaagagcagaagcaaaccacatgtctcagctatattattatttattttttatgcataaagtgaatcatttcttctgtattaatttccaaagggttttaccctctatttaaatgctttgaaaaacagtgcattgacaatgggttgatatttttctttaaaagaaaaatataattatgaaagccaagataatctgaagcctgttttattttaaaactttttatgttctgtggttgatgttgtttgtttgtttgtttctattttgttggttttttactttgttttttgttttgttttgttttgttttgcatactacatgcagttctttaaccaatgtctgtttggctaatgtaattaaagttgttaatttatatgagtgcatttcaactatgtcaatggtttcttaatatttattgtgtagaagtactggtaatttttttatttacaatatgtttaaagagataacagtttgatatgttttcatgtgtttatagcagaagttatttatttctatggcattccagcggatattttggtgtttgcgaggcatgcagtcaatattttgtacagttagtggacagtattcagcaacgcctgatagcttctttggccttatgttaaataaaaagacctgtttgggatgtaaaaaaaaaaaaaaaaaaaaaaaaaaaaaaaaaaaaaaaaaa

SEQ ID NO: 68 - DNA, 4683 bp, Homo sapiens
ccggacagcaccaggaagcccggcaggagaattctgccagatatcaggacagatggggaacagcagaagccgtgtggggcggagcttttgttcacagtttcttcctgaggaacaggcagagattgatcaattgtttgatgctctgtcatcagataaaaacagcccgaatgtctcatccaaatccttctctctgaaggcactacagaaccacgtcggggaagctcttcccccagagatggtcaccaggctgtatgatggcatgcggagggtcgacctgacagggaaggcgaagggacccagtgagaacgtgtcccaggagcagttcacagcatccatgtcccacctgttgaaaggaaactccgaggagaagagtctcatgattatgaaaatgatttctgccacagaaggtcccgtgaaggccagagaagtccaaaagtttacagaggatctggttggctctgtggtgcacgtgctaagccacagacaggagctgagaggctggactgggaaggaagccccagggcccaacccccgggtgcaggtgctggctgctcagctgctctctgagatgaagctgcaagatggcaagagacttctggggccccagtggctggactatgactgtgaccgagctgtgatcgaggactgggtgttcagggtcccccatgtggccatattcctgagtgtggtcatttgcaagggctttctcgtcctgtgctcgtctcttgatctgactaccctggtccctgagcgtcaagtggaccagggcaggggttttgagagcatcctggatgtcctctctgtcatgtacatcaacgcccagctgcctcgggagcagcggcaccgctggcgcctgctcttttcgtctgagctccatggacacagcttctcccagctctgtggccacatcactcaccgggggccctgtgtggctgtcctcgaggaccatgacaagcatgtgttcggtgggtttgcctcttgctcttgggaggtgaagcctcagtttcaaggggacaatagatgcttcctgttctccatctgccccagcatggctgtgtacacacacacgggctacaacgaccactacatgtacttgaaccatggacagcagacgatcccgaacggactgggtatgggggggcagcacaattactttgggctttgggtggatgttgattttgggaaaggacacagcagagccaagcccacgtgcaccacgtacaacagcccgcagctgtcggctcaggagaacttccagtttgataagatggaggtgtgggcggttggagacccctcagaggagcagttggccaagggcaacaagagcatcctggatgcggaccctgaggcccaggccctgctggagatcagtgggcattcgcgccacagcgaagggctccgggaagtcccggacgatgaatgaggagccgcctgagccttcctggagccaggacctggattcctctgggtagagggcaccgcctgcagcccctcttccctcccacatggtttaactgtaatagcgtaccgcacgggtcacagcctggtagtcccacatgtgccaagaagacgccctctgaagccatgtcctgactcatgggtggatctcccagaaatagatgttttttaagttttcttttttgccctacagggtcaccctcaggatctctccaagaaatcttgtgtcaaattagtaactcagtcttatactttgttcttttttaccaacgaaatcctaagcagctgagacctttcagacccccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagcattgctgggatctcaacttctctattgaggagggggttcctcccgctggggttcatatggcctcactcaggccatccctgttagaaggtggtacctgatggtctgttctgacgggtgagggacagaggcatctggatgaaaatctcgacgctttctgggaacagcttccaatggcatgggagttctgtatttaaaagcatgaactgtgtataaaatggggaaatggaggcaggagactttgaggtaacatggtctggtggtggcatgagtcctcagaaggtatttgtaataaggttccacacccagctctctcagctgtttttaaatgaatgtgtgtgaggaacagatgggaaagttgggagatctgtctacagagaagcaaagttgtggttctcttgctaacttcaaggtgagggacattgggcaccctaagtttgggaacttggttgataaatacgtatatggtccattccataaatcagtggtgagtgactggcctgggttctagacctctgggaaccagcacctgagtcacagctgtctaggcctcggtgctggcctgggttctagatctctgggaaccagtgcctgagtcacagctgtcagtgcagccatttgcccagggctgctcccgagggggatgatgggaaattcagcagtgtagactcactttaaacaagctccggtgatcctgaaatgctgaagatcgtgtaggtgggttgtggggtcagcagagctgccatctgcccacgtctggaaaacaacacacggtgagtcaccggttggccatgagatctccccacttaaaggtgctgtgagcttgtctctaagatatatacctcttccttttgtcttttgctgtaagctttgaccttttgcagatctgatgaaaatacaacctcttattgtatagtttgccttgattataagccatagtaaatcgagctgttcgcatttttgcaggccttgcattttctactgggaggttcatcaaaccttccacttagcaatagccctgactcaggcagaatgcctcataaattagccttcgaaagaaaagtgcacgctcagacagtgtgtggaggggcaggagcgtgatgcagacaaggacttagtcatgactgattttccttagccagtttgtaatggcttatggggaacattgtgagcttcctacctgacatgttggcagaagtagaatattaggatcctcaagcatctctaccgtaagtccaaagaatttaggtccctattgtcactttgttttgcaatgttttttataaaaatgcaattaaatacctcactattaaactgccatgatgcctcagttaaaaaaaaaattaaatgtccgtcagtgtctgtgccttggtgaccattgattgctgcttctgcccaggccgctgcaaaggttaggactttgtccactcacatgctttccaccctgagcttgttctaaggagagtgcagatcacgaatgcacctgcttccaggcagtgcacttagagaaagggcactggcccgggcttgggagcctgggggatgcagctctctctgtgggcttctcttggtgcacggttctgcctctggacactcaaacctttttagggcgtgtgcagggctggggccagtggacctgacagtaccttacctggctctgagaaactcgcaatcctagtttgcacaaatgaatagtttgttcttttgtgaaaccagaatgagaattcaggttctaaggactagaggtctccctacaaatgaagacttatctcagggccctagaaagtgctaggaggaagaggttaaaaaaaaaatttgtccgcgttgcaaactattataaatgattgccacattgcaagctattattttctcccaccatattttttaattaaaaaaaagtctggggccgggtgcggtggctcacgcctgtaatcccagcactttgggaggccggggtaggcggatcacctgaggtcggaagttcgagaccagcctgaccaacatggagaaaccccatctctactaaaaatacaaaattagctgggcatggtggcacatgcctgtaatctcagctactcaggaggctgaggtagtagaattgcttgaaccagggaggcagaggttgtggtgagccgagatcgtgccattgcactctagcctgggcaacaagagtgaaactcagtttcaagaaaaaaaaaaaaggctgggtgtgatggctcacgcctggaatcccagcattttgggagcttggggcaggccgattgcttgagcccaggagttcaagaccagcctgggcaacatggcgaaaacccatctctacaaaaaaaaatacgaaaattaaccaggcatggtaacacatgcctgtggtcccagctacttgggaggctgaggtgtgaggatcatttaggcctggaaggttgaggctgctataagctgtgattgtgccactgcactccagcctgggcaacacagcaagaccctatgtttaaaaaaaattgtgtacctggtttag

SEQ ID NO: 69 - DNA, 3583 bp, Homo sapiens
gcggccgccctgcgcgcgaagctcgtggcccgagaggggtgcggtcgggccgacggaggcggggccctggctgcctctctccctgctcataggctggccgctcaggcctggccggcctcggggcctcgggattcgcggcggcgctgccaatcaggcgatcgggccccgcccccccggagttgggtgaaatagaggcgggcgtcaagtgtcagtagtcgcggggcaggtacgtgcgctcgcggttctctcgcggaggtcggcggtggcgggagcgggctccggagagcctgagagcacggtggggcggggcgggagaaagtggccgcccggaggacgttggcgtttacgtgtggaagagcggaagagttttgcttttcgtgcgcgccttcgaaaactgcctgccgctgtctgaggagtccacccgaaacctcccctcctccgccggcagccccgcgctgagctcgccgacccaagccagcgtgggcgaggtgggaagtgcgcccgacccgcgcctggagctgcgcccccgagtgcccatggctacaagggtgctgagcatgagcgcccgcctgggacccgtgccccagccgccggcgccgcaggacgagccggtgttcgcgcagctcaagccggtgctgggcgccgcgaatccggcccgcgacgcggcgctcttccccggcgaggagctgaagcacgcgcaccaccgcccgcaggcgcagcccgcgcccgcgcaggccccgcagccggcccagccgcccgccaccggcccgcggctgcctccagaggacctggtccagacaagatgtgaaatggagaagtatctgacacctcagcttcctccagttcctataattccagagcataaaaagtatagacgagacagtgcctcagtcgtagaccagttcttcactgacactgaagggttaccttacagtatcaacatgaacgtcttcctccctgacatcactcacctgagaactggcctctacaaatcccagagaccgtgcgtaacacacatcaagacagaacctgttgccattttcagccaccagagtgaaacgactgcccctcctccggccccgacccaggccctccctgagttcaccagtatattcagctcacaccagaccgcagctccagaggtgaacaatattttcatcaaacaagaacttcctacaccagatcttcatctttctgtccctacccagcagggccacctgtaccagctactgaatacaccggatctagatatgcccagttctacaaatcagacagcagcaatggacactcttaatgtttctatgtcagctgccatggcaggccttaacacacacacctctgctgttccgcagactgcagtgaaacaattccagggcatgcccccttgcacatacacaatgccaagtcagtttcttccacaacaggccacttactttcccccgtcaccaccaagctcagagcctggaagtccagatagacaagcagagatgctccagaatttaaccccacctccatcctatgctgctacaattgcttctaaactggcaattcacaatccaaatttacccaccaccctgccagttaactcacaaaacatccaacctgtcagatacaatagaaggagtaaccccgatttggagaaacgacgcatccactactgcgattaccctggttgcacaaaagtttataccaagtcttctcatttaaaagctcacctgaggactcacactggtgaaaagccatacaagtgtacctgggaaggctgcgactggaggttcgcgcgatcggatgagctgacccgccactaccggaagcacacaggcgccaagcccttccagtgcggggtgtgcaaccgcagcttctcgcgctctgaccacctggccctgcatatgaagaggcaccagaactgagcactgcccgtgtgacccgttccaggtcccctgggctccctcaaatgacagacctaactattcctgtgtaaaaacaacaaaaacaaacaaaagcaagaaaaccacaactaaaactggaaatgtatattttgtatatttgagaaaacagggaatacattgtattaataccaaagtgtttggtcattttaagaatctggaatgcttgctgtaatgtatatggctttactcaagcagatctcatctcatgacaggcagccacgtctcaacatgggtaaggggtgggggtggaggggagtgtgtgcagcgtttttacctaggcaccatcatttaatgtgacagtgttcagtaaacaaatcagttggcaggcaccagaagaagaatggattgtatgtcaagattttacttggcattgagtagtttttttcaatagtaggtaattccttagagatacagtatacctggcaattcacaaatagccattgaacaaatgtgtgggtttttaaaaattatatacatatatgagttgcctatatttgctattcaaaattttgtaaatatgcaaatcagctttataggtttattacaagttttttaggattcttttggggaagagtcataattcttttgaaaataaccatgaatacacttacagttaggatttgtggtaaggtacctctcaacattaccaaaatcatttctttagagggaaggaataatcattcaaatgaactttaaaaaagcaaatttcatgcactgattaaaataggattattttaaatacaaaaggcattttatatgaattataaactgaagagcttaaagatagttacaaaatacaaaagttcaacctcttacaataagctaaacgcaatgtcatttttaaaaagaaggacttagggtgtcgttttcacatatgacaatgttgcatttatgatgcagtttcaagtaccaaaacgttgaattgatgatgcagttttcatatatcgagatgttcgctcgtgcagtactgttggttaaatgacaatttatgtggattttgcatgtaatacacagtgagacacagtaattttatctaaattacagtgcagtttagttaatctattaatactgactcagtgtctgcctttaaatataaatgatatgttgaaaacttaaggaagcaaatgctacatatatgcaatataaaatagtaatgtgatgctgatgctgttaaccaaagggcagaataaataagcaaaatgccaaaaggggtcttaattgaaatgaaaatttaattttgtttttaaaatattgtttatctttatttattttgtggtaatatagtaagtttttttagaagacaattttcataacttgataaattatagttttgtttgttagaaaagttgctcttaaaagatgtaaatagatgacaaacgatgtaaataattttgtaagaggcttcaaaatgtttatacgtggaaacacacctacatgaaaagcagaaatcggttgctgttttgcttctttttccctcttatttttgtattgtggtcatttcctatgcaaataatggagcaaacagctgtatagttgtagaattttttgagagaatgagatgtttatatattaacgacaattttttttttggaaaataaaaagtgcctaaaagatgtaaaaaaaaaaaaaaaaaa

SEQ ID NO: 70 - DNA, 2696 bp, Homo sapiens
atgcgccgcccggcttggaaggtggggcttcgcccgggggcgggccttcgccgggggtaggactccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcatgacagcgatacagtacttaagtgtctgtgtagacaaccaaagaataaatgattcatggttttttttacttggtttgttcagacaatggaaatttgcccattctgtcaaaaaaaaaa

SEQ ID NO: 71 - DNA, 5415 bp, Homo sapiens
gctctgtcagtaacacatgtgtaagagccgcggagggagcgagcgagccggctagaggccagcgccgccgccgccgccgcctccgagccgggcagcaacagccccggcagcggcgcaggctccagcgcgccgggcccggccggccgcagcccccgacgcctgggtgcgcctgcctgccggcctccgcaccgtccgccgccgctcccggggctgttgtgtctgcgactgctcccggccggaggtgcagggagctcagccgagccgccgctgccatcccggagcgagcaagcgagcgagcgcgcgggagggaggaaggcggcggcggaggaggaggaggagcgggaggagcgcgggcgggggcgggggcccccgggcgggggaatatacaaagtgaagccacattgccaaacttgcagcagcgattgcagcagttgctgccgctgcgccgcgcctgaagccgcgccgcgcgggccgagggctcctgcagctgctcgcgcgcagtcggaggcggagaaggacgaagactgagactgacacttctgctcccggccgcccggcacttacgcgggggccccccaacccgccccagagcaacgcgatttaaaaaaaaaaaaaaagccgcccttagccccctcctcccctttcctgcttctgcgagaactccctccctccctccagctccgccagcccaggcgccccttccctggaagccgagcggcttcgctcgcatttcaccgccgccgcctctcgcaatattgcaatataggggaaaagcagaccatggtgaatccgggcagcagctcgcagccgcccccggtgacggccggctccctctcctggaagcggtgcgcaggctgcgggggcaagattgcggaccgctttctgctctatgccatggacagctattggcacagccggtgcctcaagtgctcctgctgccaggcgcagctgggcgacatcggcacgtcctgttacaccaaaagtggcatgatcctttgcagaaatgactacattaggttatttggaaatagcggtgcttgcagcgcttgcggacagtcgattcctgcgagtgaactcgtcatgagggcgcaaggcaatgtgtatcatcttaagtgttttacatgctctacctgccggaatcgcctggtcccgggagatcggtttcactacatcaatggcagtttattttgtgaacatgatagacctacagctctcatcaatggccatttgaattcacttcagagcaatccactactgccagaccagaaggtctgctaaaaggtcagagtaatgcagaatgcgtgccttcatctcagatttgttcatcacaggtggatcccatgtgtcttcagtagacaagtcacctttgtagctagcaccagtgccagctccatgccattgcaccttctttagtcttgattgcccttcccgcatttattggtgtattaaaatgactgaatatgaacattaaggactccatgaacctgggctaatgggagactgtagagaaaatgaaaaaagatccaccagaggacatcttggggagggggagggagctgggggggagggaaatgactaatgaagctaattaaaagaagcattcaaatctgctttctaccctcattaacaattagcagggcactggccagagtttgtaccctgtgttttaccttaacaacattctatttgctctttgtatatttaagtgttgtaaggaaacgtgtttcaatcaaaactgaccatgagataaaggaaagagatgtggcttttgtgatattctatcacaaacacttattgtatctctgtaaaatacaatgtatgtatgcatgtaagtgtttttgtcctaatgttgctactcccatggcaaagaaaaaaaaaagaatgaaaaaaagaaaaaaatttggaaaaaaaaatcaggctcatagcagctactgtgtagaaaattccccctacttctaatttgctgaatgaagaaaaaaaaaaatcttttatttgtgatattttcagagacatttgctctagtatggtgtatttaaataataaaaacttaaaagaaaaaatatttaatggtgtttgggtttaaacactgctttttctcttctgtattttgaagaaatttagtttttattgttgttgaataacaagctcactttaaatttgaaggagttgagggaggtggagtgtatatttatttagctctgggccagtaaggtattcttcaaattacttaaccacgccattattggcaggggtacaaagtagtttctaacagggtcctttctataagtcaagaatattctgttaacagcatttcgttacacttctatatcacagtaagtcttttgtgtttataaatacttgagtgtccactattttgtttattctttttctcaatagcaaacaaagccttgggtattgatgaaaagtatgtataaaaaaaaatacggcacaaccatcctgttctcttattgagtttatagcttttgaaggaagtcacaatttctaagtcatacctgtacatattttgaagctcacttagttgtagggacccagagctctttttttatggtgatctttgattggtgaagtagccatttcctggtgacccttaggctcgtgtggttggctgtaaggtgtttattttgttttgctcctacacttctttactgactgcgtttccgtatgtattttgggggaagattctgacttcatttagtcttagtcttgagatactgagttgctggttgcaggcagcagagtgtccaccacagtgcctgcactgcccgcagagctgccctccggaaagcatgcagtataacagctagtgctggaaggaggaaaaccaaataggcctggaggctgaggttgtactgccagcttccttagatgtgagcaaatttcaactacaacttccatcacaggctaataaaaccaggtgtgtgaacgctactattttaaattttcttttttaagatggcattttattttgttccagaaaagcgcctgatgtagaccctccctctgagaatagccgtggagccatgtagagaggtgtagctcagcacatctcaactaccagtcagcttccctttgagaacttctgtgctcacttcctgttttcagagattccagggcaggggaaaaaaaaaatcagttgaacttcaaacctcctagaggagattgtaaaggcatagagttgaggtgaatagttttgttagaaccttataaaaataaaatgcaagaaaataatatgaagaaatcacatatatatgtttgaattagatgtctgtttgaattagatccttggggaatttcttcaaactagttctggttcttatatttgttttttttcctttaaggaactttctgaaggaagttagactgcgatggtaaagggggaaatgggttaatgagattgcaggcattttctatattctttttggcataagcacttatgtccctgatatgtacaaattcaaaggaggtggttaataactttagtaaataatatattgtcgcatttaatgatgtggagggctaaggtcattacggactttaaataaactattatatggctggttcctcaagcactgctgcgtatttaataatgagcttctaaaagcatttcttaagttgcagacctataagattacaaatgtcactcatgttagtataatccacatgcaagtgatgaagccttctctttgatgtgctaaattggagaaggactaatggagctatgaatatacaatagaacatatttaagtagtagtcttgctttaggtaaaacactttcttgaaaccagaggcatttcaaacaataaaacccggctctaatggggatgctctgtgtggatagaaagctactaaaaacactcaggtttattctgatgtgagcagcgattgtgtgcagttcctcccccaatctcaacattgcttaggaaaaaaaaaaatctatgagtttattccacctttcatccattgcatttgtgatgttattagttagcaagatggacactgttctttagaaaggacttatttaatattaaccacgtcatagagcaagatggcccccagtccctacaagcaagtgcaattaaaaataaaagcaaatgttactgagccctgctgaactcctgataaaaaaaattatgtttatggtacatataaatgtctcaatcatgcaaattgtcactcttgttaatgaaacaattttgtaaaaagatagtcctctaaaagggtttaatgttttttacctatctaactgtctaattagatttacacatcccgcaaggcaggggagcctgaagcttttccaaaccaaatcgtttgccactagaaactattttcagctcttcatgatttattaggaaatagtttaacccggactgtagtgtcttataaaatacaaaacgagaaaactgacacaccaaaatgaagtctgtgaaattgtcatcctcttaatattacctgtatttaaattctttcttttgcccttattaacactgatatttgaaacaactaatcatctaaaaggaagctcttaaagggctttaaatgtcaatatagtaagattctaatgtgcactactatttatataaaatatttcttagggcccataaatcatataataaacagtgaacccaagagctacatatggagtctagtgaagagttcccatgtagcctaactaattgtatttaaattgaggagatccaaaaaccccatcacccttcaccccaaagaccccttcacccttcaccagggaattctatcctgggtgctgtcccacctatgaccccttcaagaggccattggaaaaaggccatttacaagttaatgttacttatagctttgttactaagactcacctattgttagtgcagccaagtcacagaagtgcttattgcagttaaatagcaatttgtttccatgaaactgcaattaaagtattactgagcagccattttagattggcagtgctctgaacgcatgttaaacagccagctactcccacttgcagagtctgagatctgactagcagcaaagtgtagcacattcgccgatgctgggtacctagttaaagaggcatttgtagccctctgctcccatcgtgaacatgctgagagcaatgacaagtcagggctgatttttggaaggtgaacttgcaacttacctcaagtgaatactgttttcagttgtgcaagaagtgctttatgctagtagatatgtgcatgtttcctagagggaatgttttcaagttcagattgattctgctgagaatggacggcaactcggaggcctcaagccaataatgtactacaggccctgacatgttacagctgtgtaaacagggccattctatttcctaaatcacaactaataaagcagaggatgaaaatcaaaaaaaaaaaa

SEQ ID NO: 72 - DNA, 868 bp, Homo sapiens
agaaggccctcacctcacaaggaacatgaggcgccttgccgggcgcgcaggccactcccaggtcactcaggattccaagttctcccccaagacgccttcagatgctgagcggcacaagggcctccccagggactggttgcaaagcctcctgctcagcttgagagggccaccagctccccactgtttactgttgttcctgagagaggccagagggagggaccagccagggagtggccagagggacagaaggggtggccttcctgagggcagggtgggtgccccagacctgagagcgctgcaggactcccctccacaggctcaggtggagcctccccagggtcctcctggccaggaaggcagagagccgacttctttcttcagctcccaacccaggcccagcccacggcgtgggagtcggggagagggagaggaggaggaaggaggaggagagagggagcttgtcttgtccctgagcagcgctctcagggcagaggacgaccaacaacaaaaaagccaggcagagacagcagctggctgtcagcagaggagctgggctgaggcgcccaggggagcagcggcgcccacgaaggaagtacgaggacagcacgtggaggctccgcgctggggcactgctgctcagcccccaacacctgagctcccagaaacgcactcactccaggtgaggtgtgagaagctgggtggatctaactcagggaacccacggcttttgacaagaactcatctaattttccacggagccatcttctgcctgctaccctcatcatcacttaaaaaaacagctccccaggccgggcgcagtggctcacacctgtaatcccaacactttgggaggccgagggcggatcac

SEQ ID NO: 73 - DNA, 4812 bp, Homo sapiens
gcgctccagacaagatggcgcggccggtccggggagggctcggggccccgcgccgctcgccttgccttctccttctctggctgcttttgcttcggctggagccggtgaccgccgcggccggcccgcgggcgccctgcgcggccgcctgcacttgcgctggggactcgctggactgcggtgggcgcgggctggctgcgttgcccggggacctgccctcctggacgcggagcctaaacctgagttacaacaaactctctgagattgaccctgctggttttgaggacttgccgaacctacaggaagtgtacctcaataataatgagttgacagcggtaccatccctgggcgctgcttcatcacatgtcgtctctctctttctgcagcacaacaagattcgcagcgtggaggggagccagctgaaggcctacctttccttagaagtgttagatctgagtttgaacaacatcacggaagtgcggaacacctgctttccacacggaccgcctataaaggagctcaacctggcaggcaatcggattggcaccctggagttgggagcatttgatggtctgtcacggtcgctgctaactcttcgcctgagcaaaaacaggatcacccagcttcctgtaagagcattcaagctacccaggctgacacaactggacctcaatcggaacaggattcggctgatagagggcctcaccttccaggggctcaacagcttggaggtgctgaagcttcagcgaaacaacatcagcaaactgacagatggggccttctggggactgtccaagatgcatgtgctgcacctggagtacaacagcctggtagaagtgaacagcggctcgctctacggcctcacggccctgcatcagctccacctcagcaacaattccatcgctcgcattcaccgcaagggctggagcttctgccagaagctgcatgagttggtcctgtccttcaacaacctgacacggctggacgaggagagcctggccgagctgagcagcctgagtgtcctgcgtctcagccacaattccatcagccacattgcggagggtgccttcaagggactcaggagcctgcgagtcttggatctggaccataacgagatttcgggcacaatagaggacacgagcggcgccttctcagggctcgacagcctcagcaagctgactctgtttggaaacaagatcaagtctgtggctaagagagcattctcggggctggaaggcctggagcacctgaaccttggagggaatgcgatcagatctgtccagtttgatgcctttgtgaagatgaagaatcttaaagagctccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcgatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatgtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccgtgagcgacgcatgcatgtcatgccggatgacgacgtgtttttcatcactgatgtgaaaatagatgacgcaggggtttacagctgtactgctcagaactcagccggttctatttcagctaatgccaccctgactgtcctagagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaattttggagggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttcaaaaggtaagcacatttagaattttgttcttgacagttaactgactaatcttacttccacaaaatatgtgaatttgctgcttctgagaggcaatgtgaaagagggagtattacttttatgtacaaagttatttatttatagaaattttggtacagtgtacattgaaaaccatgtaaaatattgaagtgtctaacaaatggcattgaagtgtctttaataaaggttcatttataaatgtcaaaaaaaaaaaaaaaaaaaaaaaaaaaaaaaaaaaaaaaaaaaaaaaaaaa

SEQ ID NO: 74 - DNA, 4721 bp, Homo sapiens
cttgctccggcctcctcgctcctgcctgagttcggggcctggtctgggcttcgtcctggggctgggaagtttctgcgctccccgctgtccagtctgcatctccgcgcctcccgccgggcccccgcggtcccctcccgcccgcttcccccgctgccctccctcgctgccccctaccctctcccggggctcccggccctctactcccttcgggcgcgggcccctcgccccgcccgggcgcgccccccctcccccgggtcctgcggccccggatgcccgggccccgaggggctgctggcggcctggcccctgagatgcgcggggcgggggcggcggggctgctggcgctgctgctgctgctgctgctgctgctgctgggcctgggcggcagggtcgagggggggccggccggcgagcggggcgcaggcgggggcggggcgctggcccgcgagcgcttcaaggtggtctttgcgccggtgatctgcaagcggacctgtctcaagggccagtgtcgggacagttgtcagcagggctccaacatgacgctcatcggagagaacggccacagcacagacacgctcacgggctccggcttccgcgtggtggtgtgccctctcccctgcatgaatggcggccagtgctcctcgcgaaaccagtgcctgtgtcccccggacttcactgggcgcttctgccaggtgcccgcaggaggagccggtgggggtaccggcggctcaggccccggcctgagcaggacaggggccctgtccacaggggcgctgccgcccctggctccggagggcgactctgtggccagcaagcacgccatctacgccgtccaggtgatcgctgaccctcctgggcccggggaggggcctcctgcccagcacgcagccttcctggtgcccctaggcccgggacagatctcagcagaagtgcaggccccgccccccgtggtgaatgtgcgcgtccatcacccgcccgaggcctcagtccaggtgcaccgcattgagagctcgaacgccgagagcgcagccccctcccagcacctgctgccgcaccccaagccctcgcacccccggccgcccacccagaagcccctgggccgctgctttcaggacactctgcccaagcagccgtgtggcagcaaccccctccccggcctcaccaagcaggaagactgctgcggtagcatcggcactgcctggggccagagcaagtgccacaagtgtccccagctgcagtacacaggagtgcagaagccagggcctgtacgtggggaagtgggcgctgactgtccccagggctacaagaggcttaacagcacccactgccaggacatcaacgagtgcgcaatgccgggcgtgtgtcgccatggtgactgcctcaacaaccctggctcctatcgctgtgtctgcccacctggccatagtttaggcccctcccgtacacagtgcattgcagacaaaccggaggagaagagcctgtgtttccgcctggtgagccctgagcaccagtgccagcacccactgaccacccgcctgacccgccagctctgctgctgcagtgtcggcaaggcctggggcgcgcggtgtcagcgctgcccaacagatggcaccgctgcgttcaaggagatctgcccagctgggaagggataccacattctcacctcccaccagacgctcaccattcagggcgagagtgacttttcccttttcctgcaccctgacgggccacccaagccccagcagcttccggagagccctagccaggctccaccacctgaggacacagaggaagagagaggggtgaccacggactcaccggtgagtgaggagaggtcagtgcagcagagccacccaactgccaccacgactcctgcccggccctaccccgagctgatctcccgtccctcgcccccgaccatgcgctggttcctgccggacttgcctccttcccgcagcgccgtagagatcgctcccactcaggtcacagagactgatgagtgccgactgaaccagaacatctgtggccacggagagtgcgtgccgggcccccctgactactcctgccactgcaaccccggctaccggtcacatccccagcaccgctactgcgtggatgtgaacgagtgcgaggcagagccctgtggcccggggaggggcatctgcatgaacaccggcggctcctacaattgccactgcaaccgcggctaccgcctgcacgtgggcgccggggggcgctcgtgcgtggacctgaacgaatgcgccaagccccacctgtgcggcgacggcggcttctgcatcaactttcccggtcactacaagtgcaactgctaccccggctaccggctcaaagcctcccggcctcctgtgtgcgaagacatcgacgagtgccgggacccaagctcttgcccggatggcaaatgcgagaacaagcccgggagcttcaagtgcatcgcctgtcagcctggctaccgcagccaggggggcggggcctgtcgcgacgtgaacgagtgcgccgagggcagcccctgctcgcctggctggtgcgagaacctcccgggctccttccgctgcacctgtgcccagggctacgcgcccgcgcccgacggccgcagttgcttggatgtggacgagtgtgaggctggggacgtgtgtgacaatggcatctgcagcaacacgccaggatctttccagtgtcagtgcctctctggctaccatctgtccagggaccggagccactgcgaggacattgatgagtgtgacttccctgcagcctgcattgggggtgactgcatcaataccaatggctcctacagatgtctttgcccccaggggcatcggctggtgggtggcaggaaatgccaagacatagatgagtgcagccaggacccgagcctgtgccttccccatggggcctgcaagaaccttcagggctcctatgtgtgtgtctgcgatgagggcttcactcccacccaggaccagcacggttgtgaggaggtggagcagccccaccacaagaaggagtgctacctgaacttcgatgacacagtgttctgcgacagcgtattggccaccaacgtgacccagcaggagtgctgctgctctctgggggccggctggggcgaccactgcgaaatctacccctgcccagtctacagctcagccgagttccacagcctctgcccagacggaaagggctacacccaggacaacaacatcgtcaactacggcatcccagcccaccgtgacatcgacgagtgcatgttgttcgggtcggagatttgcaaggagggcaagtgcgtgaacacgcagcctggctacgagtgctactgcaagcagggcttctactacgacgggaacctgctggaatgcgtggacgtggacgagtgcctggacgagtccaactgccggaacggagtgtgtgagaacacgcgcggcggctaccgctgtgcctgcacgccccctgccgagtacagtcccgcgcagcgccagtgcctgagcccggaagagatggacgtggacgagtgccaggacccggcagcctgccgccctggccgctgcgtcaacctgccgggctcctaccgctgcgagtgtcgcccgccctgggtgcccgggccctccggccgcgattgccagctccccgagagcccggccgagcgtgccccggagcggcgcgacgtgtgctggagccagcgcggagaggacggcatgtgcgctggccccctggccgggcctgccctcaccttcgacgactgctgctgccgccagggccgcggctggggcgcccaatgccgaccgtgcccgccgcgcggcgcggggtcccattgcccgacatcgcagagcgagagcaattccttctgggacacaagccccctgctgttggggaagcccccaagagatgaggacagttcagaggaggattcagacgagtgtcgctgcgtgagtggccgctgcgtgccgcggccgggcggcgccgtgtgcgagtgtcccggcggcttccagctcgacgcctcccgcgcccgctgcgtggatatcgacgagtgccgagagctgaaccagcgcgggctgctgtgcaagagcgagcgctgcgtgaacaccagcggctccttccgctgcgtctgcaaagccggcttcgcgcgcagccgcccgcacggggcctgcgttccccagcgccgccgctgacgccgccgacgccgccctcggcccagacctcggtgatcactgagggatttccgcgagctcggcctcacttctgccccgacttgtggctcggacccagggaccttcagggcccgcagaccctcccggcgccttgagacccgaggcgcccctaccggcccccctccccggttagcgggcggttgtaaggtctccggcgggcgctgcctgccttcctcccagagggtgtttcctagaaactgataaatcagatcgtgcctctttacccttggctttcgaagcaaattgatgttcacgtctgacgtgggcgcgggctgcgcagggcggcgccagaccccagccgcctcccaggggctagactgagcccggcacaaggggtgtgaaatagaatttattgtggctctgattatgtacacgtgagatggcctggctgggccggccgggctcacatggtttgtacaataaatacatctgtggggcgggctctccgcagccgggaagggccaccgccacggttcagtccaaaaaaaaaaaaaaaaaaaa

SEQ ID NO: 75 - DNA, 2831 bp, Homo sapiens
agcccgcggagctgagcggcggcggcggcggcggcaggagcccgggaggcggaggcgggaggcggcggcggcgcgcggagacgcagcagcggcagcggcagcatgtcggccggcggagcgtcagtcccgccgcccccgaaccccgccgtgtccttcccgccgccccgggtcaccctgcccgccggccccgacatcctgcggacctactcgggcgccttcgtctgcctggagattctgttcgggggtcttgtctggattttggttgcctcctccaatgttcctctacctctactacaaggatgggtcatgtttgtgtccgtgacagcgtttttcttttcgctcctctttctgggcatgttcctctctggcatggtggctcaaattgatgctaactggaacttcctggattttgcctaccattttacagtatttgtcttctattttggagcctttttattggaagcagcagccacatccctgcatgatttgcattgcaatacaaccataaccgggcagccactcctgagtgataaccagtataacataaacgtagcagcctcaatttttgcctttatgacgacagcttgttatggttgcagtttgggtctggctttacgaagatggcgaccgtaacactccttagaaactggcagtcgtatgttagtttcacttgtctactttatatgtctgatcaatttggataccattttgtccagatgcaaaaacattccaaaagtaatgtgtttagtagagagagactctaagctcaagttctggtttatttcatggatggaatgttaattttattatgatattaaagaaatggccttttattttacatctctcccctttttccctttccccctttattttcctccttttctttctgaaagtttccttttatgtccataaaatacaaatatattgttcataaaaaattagtatcccttttgtttggttgctgagtcacctgaaccttaattttaattggtaattacagcccctaaaaaaaacacatttcaaataggcttcccactaaactctatattttagtgtaaaccaggaattggcacactttttttagaatgggccagatggtaaatatttatgcttcacggtccatacagtctctgtcacaactattcagttctgctagtatagcgtgaaagcagctatacacaatacagaaatgaatgagtgtggttatgttctaataaaacttatttataaaaacaaggggaggctgggtttagcctgtgggccatagtttgtcaaccactggtgtaaaaccttagttatatatgatctgcattttcttgaactgatcattgaaaacttataaacctaacagaaaagccacataatatttagtgtcattatgcaataatcacattgcctttgtgttaatagtcaaatacttacctttggagaatacttacctttggaggaatgtataaaatttctcaggcagagtcctggatataggaaaaagtaatttatgaagtaaacttcagttgcttaatcaaactaatgatagtctaacaactgagcaagatcctcatctgagagtgcttaaaatgggatccccagagaccattaaccaatactggaactggtatctagctactgatgtcttactttgagtttatttatgcttcagaatacagttgtttgccctgtgcatgaatatacccatatttgtgtgtggatatgtgaagcttttccaaatagagctctcagaagaattaagtttttacttctaattattttgcattactttgagttaaatttgaatagagtattaaatataaagttgtagattcttatgtgtttttgtattagcccagacatctgtaatgtttttgcactggtgacagacaaaatctgttttaaaatcatatccagcacaaaaactatttctggctgaatagcacagaaaagtattttaacctacctgtagagatcctcgtcatggaaaggtgccaaactgttttgaatggaaggacaagtaagagtgaggccacagttcccaccacacgagggcttttgtattgttctactttttcagccctttactttctggctgaagcatccccttggagtgccatgtataagttgggctattagagttcatggaacatagaacaaccatgaatgagtggcatgatccgtgcttaatgatcaagtgttacttatctaataatcctctagaaagaaccctgttagatcttggtttgtgataaaaatataaagacagaagacatgaggaaaaacaaaaggtttgaggaaatcaggcatatgactttatacttaacatcagatcttttctataatatcctactactttggttttcctagctccataccacacacctaaacctgtattatgaattacatattacaaagtcataaatgtgccatatggatatacagtacattctagttggaatcgtttactctgctagaatttaggtgtgagattttttgtttcccaggtatagcaggcttatgtttggtggcattaaattggtttctttaaaatgctttggtggcacttttgtaaacagattgcttctagattgttacaaaccaagcctaagacacatctgtgaatacttagatttgtagcttaatcacattctagacttgtgagttgaatgacaaagcagttgaacaaaaattatggcatttaagaatttaacatgtcttagctgtaaaaatgagaaagtgttggttggttttaaaatctggtaactccatgatgaaaagaaatttattttatacgtgttatgtctctaataaagtattcatttgataaaaaaaaaaaaaaa

SEQ ID NO: 76 - DNA, 3587 bp, Homo sapiens
gcccgctcggccgtggccgtgggagaggcgccgggaggctgcgggcgcggggctccggggcgggggcggcgcgaacggcgcggacggcgcgggcgcggggggctgggtcccggggcgctgctggggtggacccccccgcctcgaacttggtacgcgccagcgagaggccaggcccagcccgggcggtacaatagggttgggccgaggccgggactgggccggcgccgggcggggaacgggttcgcgaccgcagccgagagaccccgggcgaccggcacctccgagactcgcgggccacctgcctcgaccttccccggagcgcccccgcctccgagtcgctacttgccgggccgggccgggccgggcgtgatgcgccgcgggacccctgtcctggccactggccgccgccgccgccgccgctgagaccccgagacccccagtgacgccgcagccatggagagcggcccgcgtgcggagctgggggcgggcgcacccccagctgtggtcgccaggacccccccagagccaagaccttctccagaaggtgacccttcccccccaccaccaccaatgtcagccctggtccccgacactcccccggacacccctcctgccatgaagaatgccactagctctaagcagctcccactggaaccagagagcccctcagggcaggtcgggcctaggccagcccccccgcaggaagagtccccttcctctgaagcaaagagcagaggacccaccccaccagccatgggcccacgggatgccagacctcctcgaaggagcagccagccatctccaacagcagtgccagcctccgacagccctcccaccaagcaagaggtgaagaaggcaggagagagacacaagctggcaaaggagcggcgagaagagcgggccaagtacctggcggccaagaaggcagtgtggctggagaaggaggagaaggccaaggcgctgcgggagaagcagctccaggagcgccggcgccggctggaggagcaacgtcttaaagccgagcaacgccgtgcagccctggaggaacggcagcggcagaagctcgagaaaaacaaggagcgctatgaagcagccatccaacggtcagtgaagaagacgtgggccgaaatccggcagcagcgctggtcctgggcaggggccctgcaccacagctctccaggacataagaccagtgggagcaggtgctccgtgtcggcagttaacctgcccaaacacgtggactctataatcaacaagcggctctcaaagtcctctgccacgctctggaactcccccagtagaaatcgcagcctgcagctgagcgcatgggagagcagcatcgtggatcgtctgatgacgcccactctctccttccttgctcggagtcgcagcgcggtcacactgccccgcaacggccgggaccagggtaggggctgcgaccctgggagaggccccacgtggggccgggcaggggccagcctggcgcgcgggccgcaacccgaccgcactcatccctctgcagccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggtgcagaaaaaggagaagaaggacaaggagcgggaaaacgagaaggagaagagtgccctagcccgggagcgcagcctcaagaagcgccagtcgctgcccgcctccccacgtgcccgcctctctgccagcaccgcctctgagctcagccccaaatccaaggccaggccatcctctccctccacatcctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagcagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataattctgccaaaaaaaaaaaaaaaaaaa

SEQ ID NO: 77 - DNA, 3198 bp, Homo sapiens
atttgaggtgttctgaccagaagaagacagagcggatgatcattcattcaccacgttgacaacctcgcctgtgattgacagctggagtggcagaaagccatgagatttggtagttgggtctgaggggcgctcttttttttccttttctttctttctttctttttttttttttaaactgatttttgggggagagaagatctgcttttttttgcccccgctgctgtcttggaaacggagcgcttttatgctcagtgactcgggcgctttgcttcaggtcccgtagaccgaagatctgggaccagtagctcacgttgctggagacgttaagggatttttcgtcgtgcttttttttttttttttttttttttccgggggagtttgaatatttgtttcttttcacactggccttaaagaggatatattagaagttgaagtaggaagggagccagagaggccgatggcgcaaaggtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatggacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacagattcgcgcagaaaaacctctattttcttctaatccagaactggataacttgatgattcaagccatacaagtattaaggtttcatctattggaattagagaaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccagccctcttggaacagagatcatgatgacacggcatctactcgttcaggaggaaccccaggcccttccagcggtggccacacgtcacacagtggggacaacagcagtgagcaaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacacacccttacccttctgaagaacagaaaaagcagttggcacaagacacgggactcaccatccttcaagtgaacaattggtttattaatgcccggagaagaatagtgcagcccatgatagaccagtccaaccgagcagtaagtcaaggaacaccttataatcctgatggacagcccatgggaggtttcgtaatggacggtcagcaacatatgggaattagagcaccaggacctatgagtggaatgggcatgaatatgggcatggaggggcagtggcactacatgtaaccttcatctagttaaccaatcgcaaagcaagggggaaggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttgtttccatagctcttcacttcctccagaagcctccttacattaaaaagccttacagttatcctgcaagggacaggaaggtctgatttgcaggatttttagagcattaaaataactatcaggcagaagaatctttcttctcgcctaggatttcagccatgcgcgcgctctctctctttctctctcttttcctctctctccctctttctagcctggggcttgaatttgcatgtctaattcatttactcaccatatttgaattggcctgaacagatgtaaatcgggaaggatgggaaaaactgcagtcatcaacaatgattaatcagctgttgcaggcagtgtcttaaggagactggtaggaggaggcatggaaaccaaaaggccgtgtgtttagaagcctaattgtcacatcaagcatcattgtccccatgcaacaaccaccaccttatacatcacttcctgttttaagcagctctaaaacatagactgaagatttatttttaatatgttgactttatttctgagcaaagcatcggtcatgtgtgtattttttcatagtcccaccttggagcatttatgtagacattgtaaataaattttgtgcaaaaaggactggaaaaatgaactgtattattgcaatttttttttgtaaaagtagcagtttggtatgagttggcatgcatacaagatttactaagtgggataagctaattatactttttgttgtggataaacaaatgcttgttgatagcctttttctatcaagaaaccaaggagctaattattaataacaatcattgcacactgagtcttagcgtttctgatggaaacagtttggattgtataataacgccaagcccagttgtagtcgtttgagtgcagtaatgaaatctgaatctaaaataaaaacaagattatttttgtcaaaaaaaaaaaaaaaaaa

SEQ ID NO: 78 - DNA, 2081 bp, Homo sapiens
agcatgagtcagacagcctctggctttctggaagggcaaggactctatatatacagagggagcttcctagctgggatattggagcagcaagaggctgggaagccatcacttaccttgcactgagaaagaagacaaaggccagtatgcacagctttcctccactgctgctgctgctgttctggggtgtggtgtctcacagcttcccagcgactctagaaacacaagagcaagatgtggacttagtccagaaatacctggaaaaatactacaacctgaagaatgatgggaggcaagttgaaaagcggagaaatagtggcccagtggttgaaaaattgaagcaaatgcaggaattctttgggctgaaagtgactgggaaaccagatgctgaaaccctgaaggtgatgaagcagcccagatgtggagtgcctgatgtggctcagtttgtcctcactgaggggaaccctcgctgggagcaaacacatctgacctacaggattgaaaattacacgccagatttgccaagagcagatgtggaccatgccattgagaaagccttccaactctggagtaatgtcacacctctgacattcaccaaggtctctgagggtcaagcagacatcatgatatcttttgtcaggggagatcatcgggacaactctccttttgatggacctggaggaaatcttgctcatgcttttcaaccaggcccaggtattggaggggatgctcattttgatgaagatgaaaggtggaccaacaatttcagagagtacaacttacatcgtgttgcagctcatgaactcggccattctcttggactctcccattctactgatatcggggctttgatgtaccctagctacaccttcagtggtgatgttcagctagctcaggatgacattgatggcatccaagccatatatggacgttcccaaaatcctgtccagcccatcggcccacaaaccccaaaagcgtgtgacagtaagctaacctttgatgctataactacgattcggggagaagtgatgttctttaaagacagattctacatgcgcacaaatcccttctacccggaagttgagctcaatttcatttctgttttctggccacaactgccaaatgggcttgaagctgcttacgaatttgccgacagagatgaagtccggtttttcaaagggaataagtactgggctgttcagggacagaatgtgctacacggataccccaaggacatctacagctcctttggcttccctagaactgtgaagcatatcgatgctgctctttctgaggaaaacactggaaaaacctacttctttgttgctaacaaatactggaggtatgatgaatataaacgatctatggatccaggttatcccaaaatgatagcacatgactttcctggaattggccacaaagttgatgcagttttcatgaaagatggatttttctatttctttcatggaacaagacaatacaaatttgatcctaaaacgaagagaattttgactctccagaaagctaatagctggttcaactgcaggaaaaattgaacattactaatttgaatggaaaacacatggtgtgagtccaaagaaggtgttttcctgaagaactgtctattttctcagtcatttttaacctctagagtcactgatacacagaatataatcttatttatacctcagtttgcatatttttttactatttagaatgtagccctttttgtactgatataatttagttccacaaatggtgggtacaaaaagtcaagtttgtggcttatggattcatataggccagagttgcaaagatcttttccagagtatgcaactctgacgttgatcccagagagcagcttcagtgacaaacatatcctttcaagacagaaagagacaggagacatgagtctttgccggaggaaaagcagctcaagaacacatgtgcagtcactggtgtcaccctggataggcaagggataactcttctaacacaaaataagtgttttatgtttggaataaagtcaaccttgtttctactgttttatacactttcaaaaaaaaaaaaaaaaaaaaaaaaaa

SEQ ID NO: 79 - DNA, 6528 bp, Homo sapiens
cggccgccaggggtccccgctcggcgtccccgcgagacagtcgagccccggccggctgcgcggcgcgctgggtgcatgagggggctgctccggagcgacggcggctgcagctggagccaggcgctcgcccgtccgccggttggctcgccgggacctcgcgcaccggcggcagagtcccttgcgtggattggcaagcgacgccccacctgccccgagctcaccattttctttcgcgctggctgcagctgacccggcgaagggagccgaccgggccctgggctggaggtaaaaccccacggaaagaacatgaggttcccttggaaatcattcaagaggaagatggaaggggctgtttagaagagcttaaaagctacaggctgtaagactggggcctgagtgctggcagtggaaaacactgttgggctgtgatctctccctgaaaagttccaggtgccttttcgcttcctgcaaaagaaaggaagcgaaagagaagaccatgtccatagccctgaagcaggtattcaacaaggacaagaccttccgacccaagaggaaatttgaacctggcacacagaggtttgagctgcacaaacgggctcaggcatccctcaactcgggtgtggacctgaaggcggctgtgcagttgcccagtggggaggaccagaatgactgggtggcagtacatgtggtggacttcttcaatcggatcaacctcatctatggcaccatctgtgagttctgcaccgagcggacctgtcctgtgatgtcagggggccccaaatatgagtatcggtggcaggatgatctcaagtataagaagccaacagcgctgccagctccccagtacatgaaccttcttatggattggattgaggttcagatcaacaacgaggaaatatttccaacatgcgtgggtgttcccttcccaaagaacttccttcagatctgcaagaagatcctgtgccgccttttccgggtctttgtccacgtctatatccaccacttcgaccgggtcattgtgatgggtgcagaggcccatgtcaacacctgctacaaacacttctattactttgtcacagagatgaacctcatagaccgcaaggagctagagcctttgaaagaaatgacgagcaggatgtgtcactaatgctccacctcaccctttggaagaaaggaaagctgtttcctcctggtgccctgagcgggcaggaggtggaccaccctggctgaaatgacacacctactcccaggaacagcagaggtggaggcaagcagtgactcctgagagacattccccactcactttgtgtgctcttaaccttctgagtgctgctagcccagacctgtggacgaggcagaccacaacgtgaaagaaggaccagccccttgaccgttctggctggggaattgtccacgaggaagcctctgcacttccacacatggcacagttctgcctgtgacctgccgcctaagctttactggaattcaggttttgagactgagatgcgtgttcgtatttttccacttatctgtcttgtcagctggccgacttctctgtgattggttttttaagtgccgggtgaattttggacctctggatgtgcagcaagtttttatgcaataagccttcctttcaggtctctaaaagctcctgctctgatctgtggtttaacactgtgcagggctgtggagctctgagacacctgaacccctacccatcccctgcacctccctactctccctgccgaggcgtccatagcatttccctaataaatagttttatcagggacactccatggggtggcttgtctctgccccaaacagggtcttcacgttctaactgcagggaagagactggttactagcgtaaagctgacaagttaccagttcacctgatcagaatgtattttttataaccaccatcattccttgtctcttcagtggaagatattctttcctgtttcccagaagagagaaataaaagtcctaaataactaagaatgatcagcgggagcgttgggcatgattactgcagtgtttgttctttattaaagacagggagtcgtggctgtctctacataatactaacatttcagtgaaaaaagtacaattggttatttggtacgtgtagatttaacacccagacggctgacttgtaaccctccccactagccttctgagcatttaaacccagccgtcattctctccccactccacgctccccactcctctgccacgttatgttacggcacaaaattaatttctgcccctgtgattgggccacggttgccaaggtaacagtggagctggagctaacttccttctttcatcctttccaatttttctattccagaagacagtcagaataatgcattctgtactacatcctgccttttgaaacctaaatgagttttcgttgatgaaatgttgccttctctgattcattcacaaaactgtggtggttctgaccacctgtgacgaggggggtcataatacttccagtgatccttttaatttagcaaaatatttgtcggtggagggaagtagataagaatgtattagtgtattttaaagtaataatgattaaagaataactaaatgactctgattttgttttatcaatcataatgtgttaaagccctctgtggctgccacaaaagactagaatcatgaaatctttgtccaagctaagaaagggctgtctctgtgggtacagtggcattctctgttgacctaaccaagcagcctgaaccttgctttgtgtctcgtaaaggtcatctcacggaatccaattgctgctacctcaccatgttgctgtgccctggtcaacaataaacatacttttgtcccccttcctaagtaactttgagaggacaagataggcaaagttttttccctacatctcttttggccaaaagaatatctgaccatcacagagatccagagaacagaaacaagagcccctaagtcccagcctctgcaatacacagttaccagatgggaatgcagcacagtggcacagagaggtaactacggagcccatgccctggaggaactctgtagctgtgcatcatggaacgccacaggatttttacattaaaaagttgaatatgttcctgcatttcagcagtgcataatcgagcaggaggctggaatctggagacctttgttattcattctttttaaggttattttttattaactgtgcatatgaaatttccactcaatttaaaaatccaaatctttttaagcttcttggaagaatttcctcctgcttatattgttaattgcactaatgaactcttctagggtaaattctggcaaactaccctttttttttttttaatcacagaatattcctgttcccacagaactttggcacattctgaagaaaatctctgcagtcaatttttatctcctctgcttgactgcatctaactgttcatctctgttataaatggagcttcagccctctgggtcagagactgacaaccctccttcttcttcctaacctgtcctactctccttctttttctgctttcattttaattttgggaaattttaaagtaaaagtttcaaagttgaaagattatagtgagtacccttatgtcctttagtgcatcagttgttaatgttttgccttgttttcttttcttccttttttttttttaagagaaggggtctctccctattttacccaagctggccttgaaccccttgcctcaagtgagcttcaaccttagcctcctgagtagccaggactatggcatgtaccaccgcacctgcctcacattttctttctcactgtaaatacacattcttattcttgaaccttctgaaaataagttgcagacatcatgaaaatgtaaaatacttcatcatattctttcttttaataagagcattgtcctataaatctgcaatattttcacgcccatgaaactgaacactgatactgcataaatctaatatatgatccatattcaaaattctccagttgtccccaaaatatcctttatagctgtttatttttaaatccaggatccaatcaagaattatacgttatatgtagttgtcattctcttttgtttcctttaattgattagagttgcccttttgtgtgtgtctgagtggtgggtggtggggtggtgtttgtgtatgatgtgcagtgtgtgtgtgtgtggtgtgtctttcatgacactgacattattaaagagttcaggcaagtttgtggaatgtcccacaatctagacttttttactgattgtttcctcattacgagatacaggttacattttttttcccaagactgctacatgtgtgatgttgtttccttactactgcctcacctcaggaagcacataatgtctacttgtctcttttctgatattaggactgatcaggtgttgtctgcctgatccaatcattatcaagttccataattcattattaagctctgaaattcaggacacatacatttatagagtgtgaggctgtgcatacgtacattcatcccttaatgttctcaaggaggcccaggatccccaaaatattataagcattgcagtcagatgatatagcactagcaaagcattcatccctttccatataacaggagggaggggaagaaggaagtttccatgtgcaggcaatacgtgagagcatgggcaagtgaggatttgtatgctccctgtagccagaggtgaaatattcaacgcttttattttttctcccgtcttcaatgacctcccatttggacccatagtttatttatagagagcacacactccctaattgtcagatggtttttttgggaaaactcttagatagtacagtgagttgtgaccctccaaaggatcacaagtacataaacagatacaaagtatttatgtggtattaaaatttcatggtgatggtgcaagggagagatgattaggaagaaaatgtcttacacggctgtaattgagaaatactgatctagagtcatttcctgcttcttaaattgttcgttttctcttccctgggtattttctcatttccaaagacccagagtctcagagccaggttaagtggaagaaactttgagaggtttcttaatcaattccttctatctctcaaaccatgccagtaacttccttggtgaaaaaatctatactcctctcacagttcttcgggcatggaaattctatagcattctttggtataaccaacccactgaaccctccacaacatcttgaattccattcaactcgagctgaagtattctttttgagtttcagtatatcttttctagtgtcccacttttagaaaggtccaaagatgatatataataagtgaaaatacaattaatcagagctttatttgcatatccattaaatatctgaaggctattaccagttgtgcttcagcctcctttcccttgcaattctcccagggtggcatcctctacggagtcttgttgctccattgttgaccactgatgtaactcaacgtgaaaccttcccaaagctctccacatcactctctgttatggctgtgaccagcagtgaacatgaaaagaacttatttcatgccttctccaaactatattgtttctttgctaagtccagacctgctttttctacatttataggttttctattttaatcgccatgcaaaattctttatcatactcaatcattttggtttatcttcctgacttcttacctttaacatccctgttaaagattacactgttgttgtttcaaaaaaaaaaaaaaaaaaaccttaattggcaaaacattaagggacttgaatagaattacacttatctttttgtgctgatttatgtcaatccatcattctggttattgatggaagcaaattgcttcctatgttctctaaaccttatgtcccttccatactccatgagtaccacactgggagaaaacaaaagcaaaaagattgtgggaaaagtatagccattatctttgaggaaatgtgtaccaaggcacaatcattaaaaggagttggaggcatcatttggttgacactgttgtcattcttgttctgatcattttggaccttgaagaaattggtgattctctcctagaattagacaaacaaagtgtgtttggaaataatgattgttttcctgccttaaaaaatatattaacagaaagcttttataacaggctgtttccctctggacaggtattaattctgagtaagaattttcagtgactacataaggatttgtgtaacttatgaaggaagagtccatttctaatcaaataattcgcctgttttactagcttatagtgatctgatttcagaattttcctgtatcttttttacatacatcagaaaaagaaatgtttactatatttttggttccatttatgattgtattaagcatttgactataaggaaaactaacaattaaatcaattagaaaagcaacataaaattaaatgatatttaggaaatcagttatatgtgagcttgggtattcaaatgtcacaaataaaaagcatataaccattaaaa

SEQ ID NO: 80 - DNA, 2531 bp, Homo sapiens
acttgcagcctcggacgcgcggcgaggcggccgccgccggaggagcccccgcccctgcgcgcctccctcccgggagcccctgcctccctcggtgcgcgctgctgctcgcagccgccgcggccgccgaagaggagcccggggccagtctgtttccaggtctggcggggggccgggctgcggtggcggcagcggtgggagatgccggggcggccggcggaggtccatgtggcgctctaggtgggatgccagcgtcctgaaggcggaggccctggccctcctcccctgcggcctgggcatggcattctcccagtcccacgtgatggccgctcggcggcaccagcacagccggctcatcatcgaggtggacgagtacagctccaaccccacccaggccttcaccttctacaacatcaaccagggccgcttccagccaccgcatgtgcagatggtggacccggtgcctcacgatgcccccaaacctccaggctacacccgcttcgtctgcgtctctgatacccactcgaggacggaccccatccagatgccgtacggcgacgtgctgatccacgctggggacttcactgagctggggctcccgagcgaggtgaagaagttcaacgagtggctgggcagcctgccctacgagtacaagatcgtgatcgcaggcaaccacgagctgacctttgaccaggagttcatggccgacctcatcaagcaggacttttactacttcccatctgtgtcgaagctgaagccggagaactatgagaatgtgcagtcgctgctgaccaactgcatctaccttcaggactcggaggtcaccgtgcggggcttccggatctatggctccccatggcagccctggttctacggctggggcttcaacctcccgcgaggccaagccctgctggagaaatggaacctcattcccgaaggcgtagacatcctgataacccatggaccaccactgggcttcctggactgggtccccaagaagatgcagcgggtgggctgtgtggagctgctcaacacggtgcagaggcgcgtccagccgcggttacatgtctttggccacatccacgaagggtatggtgtcatggcagatgggacgaccacctatgtgaatgcgtccgtatgcactgtgaactaccagcccgtgaacccgcccatagtcatcgacctccccacaccccggaactcctgactgctccccactgcccctgccctgcccgcccgtgtcagctccacaggcctggcccggccactgttccttccatgctgagttgcctggacgacccatctggctgcggggactggcctagcaggcaggtcagggccttggaacgactctttagccttctgtcacctggagttgggaccctgcgcatccccatcaggggttctgtgctcatttactttttctgcgtgtacatcctgcgtgtacctcgttaaaggacctactaagctcatggccctgtcatgtttgggaaatgactaaatcttcattcttctcccttggacgccctcctggtttgggaagctgctgctcttgaatgggttttggaagttacacaaaatctccctctaaccacgggtctgtgtggcggcatgcccctgggttggggtgggtgggaggattcgtgagctgcacacagacagtccctttctctcctcccaagtgagggaggagacaggcccaaggcggaggccctccgagggagcatttagggacatctcaggaattcagaccgcacctggccaggcccacagctgtttgcctggcattgttcccccctttttcttcccataggcatttttgtttacttgaacaatgacctgagtgtcctaggcattcactcggagcctggatgatgggggctggttctacagaatgagccactggcattcgtgcccaggaccagtgagagcgttcccagtcatggggggatgacccttggtcccacggggaacacactgctctgtagaatgcggtagcctggatggagggtctgcaggcttaggctgcagcaggcctgccatgggtgtgaacccatgtccaggcacgcaccgacacacatgcacgcacgcacccctcttaattgaaccaagtgggtcctgtgtttctcttttctgccccgtagtgaggttctgttccttggtgcggcttcccttgcaccgttaggattctgtctggcatgcctgcagccgaggaagcccaggaccagccggccctgtgaattggagggtggcacagggaccgagcgggccccaggctccagcagccccaccttggacagcttctttttcttctttgaattaggactggagggggtggggccagggcggtggtgggaaccggtagggcctagatgaggggcaggcagtcaggcagaaatgggcaagttcagggtcagattctgtcgttatttaatattttgttcatcatggactttttctgcatttattttgatttttaacgttgcattaaagtagtattatttgtcctgaaaaaaaaaaaaaaaaaaaaaaaa

SEQ ID NO: 81 - DNA, 2271 bp, Homo sapiens
ggctctcgcgctggggaggcggctcccgcgctgcagccctgctccggcgccccgcgccgcctccgctgcgggtcgggagcgcgcgtctccgccgcacctcggatctaggagctactcgcccggccctgggcggtgggaggcggcggcggcggcggcgctcgcgcacctcggaggagccaggagccggaaccagggccgagcccgcgggccggggctagccagccggtcggagatgtccgcccagaggttaatttctaacagaacctcccagcaatcggcatctaattctgattacacctgggaatatgaatattatgagattggaccagtttcctttgaaggactgaaggctcataaatattccattgtgattggattttgggttggtcttgcagtcttcgtgatttttatgttttttgtgctgaccttgctgaccaagacaggagccccacaccaagacaatgcagagtcctcagagaagagattcagaatgaacagctttgtgtcagactttggaagacctctggagccagataaagtattttctcgccaaggcaacgaggagtccaggtctctctttcactgctacatcaatgaggtggaacgcttggacagagccaaagcttgtcaccagaccacagcccttgacagtgacgtccaactccaggaagccatcagaagcagtgggcagccagaggaggagctgaacaggctcatgaagtttgacatccccaactttgtgaacacagaccagaactactttggggaggatgatcttctgatttctgaaccacctattgttctggaaactaagccactttcccagacctcacacaaagacctggattgagaaacatgctctgtaaagggtcttcctgaagatgtggattctatctttatgtagcaagaaatctacatccaccaaaattgtgtgtgtttgggggagagagagacatagagatagagacagagaggcagagaagagacccctttagaagagagctgagctgattaagctgagtggttttttgttttgttttgtttttgctttttaatacatttggagctttgggagtattaaagtatttacaccaagcttgtccaacccgtggcatgtgtcccaggacagctttgaatgtggcccaatacaaattttaaactttattaaaacatgagttttgtttttttttttgctattttttttaaagctcgtcagctatcgttagtgttagtgtactttatgtgtggcccaagacaactcttcttccagtgtggcacagggaagctaaaagattggacacctctgatttatactagctcgttttgcttgttgaaaaatttggccaaatacctattgtcagcattcttgggtgaggattagcctaccatgttctaatctggccctgccactactatgctctacctttggtgagttgctttacctctctgggctgccccatttttaactgtaggttgacaggtctagagtgatccatcccacctctaatattttgtgaatttatgactttgccttcagatgaggctgagctatacataaaacagtataaactagggtactgcctcgtatctcttgtaggctctctcaaatctctgtaccttccacttaaccctaattgagccaagctttagtcaggggatctggttgtctaccagaatgtcaggagactcatcttacacagtcatggtggccaatgtttctggtgggttgtgctgaaacagctcttctgagaacttccaaccacccatgctctaacctggagacagccatcccctgcctcagaataagtaccaattcgtagtacatgtatggtactcttgtccccaagaaatgttaggaagcttgtcagctgaatgagaggaggtgccttctgggtatctctgtgttggtgtatctgtgccattggctacagaacaagaaaaatactatttgccatgctattaccttggcagatgtgtaggtgatagtcatctggctttgagctgagatggtcagtgggttgtaaattccccactagcagatattcagggtggcctgagttatgtaaacaagtgagcaacacagctttaatttcatggaggaatcaaagctgcacactggtattaaaacaacttgattttgcgcacacagttgcatgcatggcaagctgttaacctctgggtggcattttcattatgaatttgttcaccacctgtcttgcttaagctacaaaataaatgcatttgactgcacagaaaaaaaaaaaaaaaaaa

SEQ ID NO: 82 - DNA, 2611 bp, Homo sapiens
acatttgtgatcacctggtcacacacctgggcaggaggctgcccctcctccctggtttgaggaagcaggaaaaggtacccgcgagagacagccagcagttctgtggagcagcggtggccggctaggatgggctgtctctggggtctggctctgccccttttcttcttctgctgggaggttggggtctctgggagctctgcaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacagctctgaagaggcaaagacactcacaatggacatattgacattggctcacacctccacagaagctaagggcctgtcctcagagagcagcgcctcttccgacagcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcctccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacggttgggaccccactccccactaacagcgccacagaaagagaagtgacagcacccggggccacgaccctcagtggagctctggtcacagttagcaggaatccccttgaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctgaccccagatgtggcaacaggaccctcgctcacatccaccggagtgtatgtgtggggaggggcttcacctgttcccagaggtgtccttggactcaccttggcacatgttctgtgtttcagtaaagagagacctgatcacccatctgtgtgcttccatcctgcattaaaattcactcagtgtggcccagaaaaaaaaaaaaaaaaaaaaa

SEQ ID NO: 83 - DNA, 16819 bp, Homo sapiens
ctcttttgtcctcttcccaggttccctggccccttcggagaaacgcacttggttcgggccagccgcctgaggggacgggctcacgtctgctcctcacactgcagctgctgggccgtggagcttccccagggagccagggggacttttgccgcagccatgaagggggcacgctggaggagggtcccctgggtgtccctgagctgcctgtgtctctgcctccttccgcatgtggtcccaggaaccacagaggacacattaataactggaagtaaaactgctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaacaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacatttgatccagaaggacaatcaccagcaactttctcaaggacttctactcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccacctcatccccttccagtgtcagcaatacattcctggtaacatcaaaggtgttcagaatgccaacctccagagactctactcttggaaacacagaggagacatcactatctgtaagtggaaccatttctgcaatcacttccaaagtttcaaccatatggtggtcagacactctgtcaacagcactctcccccagttctctacctccaaaaatatccacagctttccacacccagcagagtgaaggtgcagagaccacaggacggcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggacagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcccaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctcccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcagcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccactgggcttacatctccacaaaccgagacccacactctgtcaccttcagggtctggtaaaaccttcaccacggccctcatcagcaacgccacccctcttcctgtcacctacgcttcctcggcatccacaggtcacaccacccctcttcatgtcaccgatgcttcctcagtatccacaggtcacgccacccctcttcctgtcaccagcccttcctcagtatccacaggtcacaccacccctcttcctgtcaccgacacttcctcagaatccacaggtcacgtcacccctcttcctgtcaccagcttttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcatgtcactgatgcttcctcagcatccacaggtcaggccacccctcttcctgtcaccagcctttcctcagtatccacaggtgacaccacgcctcttcctgtcactagcccttcctcagcatccacaggtcacgccacccctcttcttgtcaccgacacttcctcagcatccacaggacacgccacccctcttcctgtcaccgacgcttcctcagtgtccacagatcacgccacctctcttcctgtaaccatcccttccgcagcatccacaggtcacaccacccctcttcctgtcaccgacacttcctcagcatccacaggtcaggccacctctcttcttgtcaccgacacttcctcagtatccacaggtgacaccacgcctcttcctgtcactagcacttcctcagcatccacaggtcacgtcactcctcttcatgtcaccagcccttcctcagcatccacaggtcacgccacccctcttcctgtcaccagcctttcctcagcatccacaggtgacaccatgcctcttcctgtcactagcccttcctcagcatccacaggtgacaccacccctcttcctgtcaccgacgcttcctcagtatccacaggtcacaccacccctcttcctgtcaccagcccttcctcagcatctacaggtcacaccacccctcttcctgtcaccgacacttcctcagcatccaaaggtgacaccacccctcttcctgtcaccagcccttcctcagcatctacaggtcacaccacccctcttcctgtcaccgacacttcctcagcatccacaggtgacaccacccctcttcctgtcaccaatgcttcctcattatccacaggtcacgccacccctcttcatgtcaccagcccttcctcagcatccacaggtcacgccacccctcttcctgtcaccagcacttcctcagcatccaccggtcacgccacccctcttcctgtcaccggcctttcctcagctaccacagatgacaccacccgtcttcctgtcaccgacgtttcctcggcatccacaggtcaggccacccctcttcctgtcaccagcctttcctcagtatccacaggtgacaccacgcctcttcctgtcactagcccttcctcagcatccacaggtcacgccagccctcttcttgtcactgacgcttcctcagcatccacaggtcaggccacccctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactaactcagcatccacaggtgacaccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttccggtcaccgacacttcctcagtatctacaggacaggccacccctcttcctgtcaccagcctttcctcagcatccactggtgacaccacgccgcttcctgtcaccgatacttcctcagcatccacaggtcaggacacccctcttcctgtcaccagcctttcctcagtatccacaggtgacaccacgcctcttcctgtcactaacccttcctcagcatccacaggtcacgccacccctcttcttgtcaccgacgcttcctcaatatccacaggtcacgccacctctcttcttgtcaccgacgcttcctcagtatccacaggtcacgccaccgctcttcatgacaccgatgcttcctcattatccacaggggacaccacccctcttcctgtcaccagcccttcctcaacatccacaggtgacaccacccctcttcctgtcaccgaaacttcctcagtatccacaggtcacgccacctctcttcctgtcaccgacacttcctcagcatccacaggtcacgccacctctcttcctgtcaccgacacttcctcagcatccacaggtcacgccacccctcttcctgtcaccgacacttcctcagcatccacaggtcaggccacccctcttcctgtcaccagcccttcctcagcatccacaggtcacgccatccctcttcttgtcaccgacacttcctcagcatccacaggacaggccacccctcttcctgtcaccagcctttcctcagcatccacaggtgacaccacccctcttcctgtcaccgacgcttcctcagtgtccacaggtcacgccacctctcttcctgtcaccagcctttcctcagtatccacaggtgacaccactcctcttcctgtcactagcccttcctcagcatccacaggtcacgccacccctcttcatgtcaccgacgcttcctcagcatccacaggtcacgccacccctcttcctgtcaccagcctttcctcagcatccacaggtgacaccacgcctcttcctgtcactagcccttcctcagcatccacaggtcacgccacccctcttcatgtcaccgacgcttcctcagtatccacaggtgacaccacccctcttcctgtcaccagctcttcctcagcatcctcaggtcacaccacccctcttcctgtcaccgacgcttcctcagcatccacaggtgacaccacccctcttcctgtcaccgacacttcctcagcatccacaggtcacgccacccatcttcctgtcaccggcctttcctcagcttccacaggtgacaccacccgtcttcctgtcaccaacgtttcctcggcatccacaggtcatgccacccctcttcctgtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagcccttcctcagcatccacaggtcacgccacctctcttcctgtcaccgacacttccgcagcatccacaggtcacgccacccctcttcctgtcaccagcacttcctcagcatccacaggtgacaccacccctcttcctgtcaccgacacttactcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtgacaccacccctcttcctgtcaccgacacttcctcagcatccacaggtcacgccacccctcttcctgtcaccaacacttcctcagtatccacaggtcacgccacccctcttcatgtcaccagcccttcctcagcatccacaggtcacaccacccctcttcctgtcaccgacgcttcgtcagtgtccacaggtcacgccacctctcttcctgtcaccgacgcttcctcagtgttcacaggtcatgccacctctcttcctgtcaccatcccttcctcagcatcctcaggtcacaccacccctcttcctgtcaccgacgcttcctcagtgtccacaggtcacgccacctctcttcctgtcaccgacgcttcctcagtgtccacaggtcatgccacccctcttcctgtcaccgacgcttcctcagtgtccacaggtcacgctacccctcttcctctcaccagcctttcctcagtatccacaggtgacaccacgcctcttcctgtcaccgacacttcctcagcatccacaggtcaggccacccctcttcctgtcaccagcctttcctcagtatccacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccttcttcctgtcaccgacacttcctcagcatccataggtcacgccacctctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccaccccgcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcaggccacccctcttcctgtcaccagcctttcctcagtatccacaggtgacaccacgcctcttcctgtcactagcccttcctcagcatccacaggtcacgccactcctcttcttgtcaccgacgcttcctcagcatccacaggtcaggccacccctcttcctgtcaccagcctttcctcagtatccacaggtgacaccacgcctcttcctgtcactagcccttcctcagcatccaccggtcatgccacctctcttcctgtcaccgacacttcctcagcatccacaggtgacaccacctctcttcctgtcaccgacacttcctcagcatacacaggtgacaccacctctcttcctgtcaccgacacttcctcatcatccacaggtgacaccacccctcttcttgtcaccgagacttcctcagtatccacaggtcacgccactcctcttcttgtcaccgacgcttcctcagcatccacaggtcacgccacccctcttcatgtcaccagcccttcctcagcatccacaggtgacaccacccctgtgcctgtcaccgacacttcctcagtatccacaggtcacgccacccctcttcctgtcaccggcctttcctcagcttccacaggtgacaccacccgtcttcctgtcaccgacatttcctcggcatccacaggtcaggccacccctcttcctgtcaccaacacttcctcagtatccacaggtgacaccatgcctcttcctgtcactagcccttcctcagcatccacaggtcacgccacccctcttcctgtcaccagcacttcctcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccagcctttcctcagtatccacaggtgacaccacccctcttcttgtcaccgacgcttcctcagtatccacaggtcacgccacccctcttcctgtcaccgacacttcctcagcatccacaggtgacaccacccgtcttcctgtcacggacacttcctcagcatccacaggtcaggccacccctcttcctgtcaccatcccttcctcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacacgtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacggcacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcaggcgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatgacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaagtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaaaaaaaaaaaaaaa

SEQ ID NO: 84 - DNA, 3681 bp, Homo sapiens
aatatcaacctgtttcctcctcctccttctcctcctcctccgtgacctcctcctcctctttctcctgagaaacttcgccccagcggtgcggagcgccgctgcgcagccggggagggacgcaggcaggcggcgggcagcgggaggcggcagcccggtgcggtccccgcggctctcggcggagccccgcgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctgattcttcatcatggtgtgatctcagcagttttgaattctttgaagaagcagatttttcacctagccaacatcacacaggcaaagccctacagcttcagcaaagagagggcaatgggactaaacctgcaggagaacctagcccaagggtgaacaaacgtatgttgagtgagagttcacttgacccacccaaggtcttacctcctgcaaggcacagcacaattccactggtcatccttcgaaaaaaacggggccaggccagccccttagccactggagactgtagctccttcatatttgctgacgtcagcagttcaactcccaagcgttcccctgtcaaaagcctacccttctctccctcgcagttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttattttacctacaaa

SEQ ID NO: 85 - DNA, 1579 bp, Homo sapiens
gaggaggtgcttgccagacactgggtcatggcagtggtcggtgaagctgcagttgcctagggcagggatggagagagagtctgggcatgaggagagggtctcgggatgtttggctggactagattttacagaaagccttatccaggcttttaaaattactctttccagacttcatctgagactccttcttcagccaacattccttagccctgaatacatttcctatcctcatctttcccttcttttttttcctttcttttacatgtttaaatttaaaccattcttcgtgaccccttttcttgggagattcatggcaagaacgagaagaatgatggtgcttgttaggggatgtcctgtctctctgaactttggggtcctatgcattaaataattttcctgacgagctcaagtgctccctctggtctacaatccctggcggctggccttcatcccttgggcaagcattgcatacagctcatggccctccctctaccataccctccacccccgttcgcctaagctcccttctccgggaatttcatcatttcctagaacagccagaacatttgtggtctatttctctgttagtgtttaaccaaccatctgttctaaaagaagggctgaactgatggaaggaatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcagaccagaacctgcaggagctggagaagtggctgaagaaagagccagaggcctttgactggtccccagtggtgacctatgtgtgtgatcttgaagggaacagagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtca

SEQ ID NO: 86 - DNA, 4895 bp, Homo sapiens
cgccgcgccccctgccccacctccgctcgcggttgccatgaagacccggtccgggagcagtcgactgccggagactcgggaggctgagctttcctcggcctgagccagccagaccccgggcaccgcgctcacccctcttcgccgccacgtccgcgaaggcctcacgcgcgaggccaggcgaggccccgaggcgcccaccacttcacgacaccggagcgaaccgggcgccagaggctgcgacccccctgccccgaatcctgccggtgggagtggctgcatttgaaccaaacggccttcgcgggcagcagccgtcgccccgcagtcccggggctcccaagggcctgtgaccgacgccgccctccgcgtcttcgtccccgaagccccgggaaccatccgccctcgggagaccatgctgcagatgcgaggaaagccgtttcctggaacatcggaattctaaccccagggtgaaggactcacgacaggcgaggggcagacatgctgaattccacgggcgaactggagttttcgaacgaagaagatcccgagatcatctcccaactcacttccctgcctctgtccggtgggaaaagctcagctggtgtgcccgaaaaaacgggctatccggactccgtttatgtcatggcagccaacatttttcagggtattcgaatcgaaaagtcggcacagaaagtcttaatcaagtatgggaatgaacccctgcggtccttgtccgagtctgaggatcagtcctttcagcgtttgtcttatgagctggctttcagtgccctgaaatatcaagatattttggaaactatattgatagacagctgtatcttcccaagtaccacaataccagatcatttgagcagtcttattattgtgatgctatatgatttccaagatagaaaatttcaaactcgtgtcctttctgataatgaagagcccatatcagaagttcaagaagtagagaaccttcttaacagttttaagataaaattggctgcagcattggcaagatgtcgaatcaagcatgatgccctttcaatttaccacatccttccagaaacagttaggaaacaggaactaagggcctccactttaccactttatgcttggataaatacttgtaaaatcagccctgaagaagtttataataatttgaagagaagaggctataataaagtcaaatctgtattgcatattgatgataaagtctttgctgtggatcaacattgctatgatgtcttaatttttccatctcatcttaaaaatgatcttataaatatagatcttttcaaagattacaaacttatatttcaggacaaatctcgaagtcttgctgtccattctgtaaaggctttattaaatatggatgatgatgtcttaatggtcaatacaggctcatggtacacagtttcccacatgtcaattttaacaaataataatacctcaaaagtatttgtgtgtggagtacaatcacaagctaaggatcctgacttgaagacccttttcacaaaaataggatgtaaaaatattgaaatacttcatgagaaatttattaacattgaatcaaaggatcacaggttacagaaagttaaagtgattttgctgctacctcgttgttcaggactgggtgttagtaatccagtagaatttattttaaatgaacatgaagatacagaattccttaaagatcactctcaaggaggcatctcagtggacaaacttcacgttcttgctcaacagcagtatgaacagctaacacatgcaatgaaatttactaaagctcaagcagttgtttactgcacatgttcagtttttccagaagaaaatgaagctgttgttaagaaagcactggaatttcaagaccttgggaataaaggacaaccttacaggcttagtcctcctgttcttccactgtgctccttaaaggaaattcaattgtctactgataaatttttcagaatggaaccatctgaaattaccaatggttgttttctttctattttaacaagggagcgggacccttctgagacagtgtctgtgaatgatgttttggcccgagctgcagccaagggtctgctggatgggattgagttgggtaaatcatcaaaacgggagaagaagaagaaaaaatcaaaaacatcattgacaaaaggtgccactactgataatggcatccaaatgaaaattgctgagttcctgaatcgagaaactaaagccagtgctaatctatcagagactgtaacaaaaccacctcttccccagaaaaatactgctcaagtgggggcttcctcacagaccagaaaacccaacaagctggccccccatcctgcagtgcctgcatttgtgaagaacacttgtccctccagaccgcgtgaacggcagacacacttcttaagacctcggccagaagacagaatggttgctctgaaacccatcgagattgttctgcctccagtctttatgccattttcaagtccccaagggatcagatctcggatgccaactcaacatttgtactgtcgttgggttgcacccaaggcacttgtgcccacctgccttcccacacactcactatccagaaaagaggaaaagcctaaagatgacacaccttcctccctactcaggcctcctcggcgatggctttgattgtcttgtgttttttataggggccaaagagcagttgattttttttcaaagtctagtatttctctgaagattctacatctctacacaagatattcattcttttggtcacctagggatcttctaagtgtgatattactttcagagaattcagacaagtgagaaacaataatgtaggagtcagcaaagcagaattcagagacttcagccaatcactgctgctctgagaggatccagttagagactcagtatcagcggtcagaacttatctcactcctgtgaactttcaggctggacttaaagctgccaagtttcccctgcagggaaggaaacactgcctcccttcagcaggtagctcattagaaagccaaacaggcaaacgatcctggcctctcccgccagctgaccgctcttcagcatccatgcggttgtagtcgtgactttctcagtcacgatcaagggtgattttttcttaaatatcaagctgttctttgaacagggaatgaacatgagtttttgtaacgtgactgaagttgagtttaagtaggaagcgcaggaagttcccaagtgccaggtgtgtgtagctcagagttccttttacagtgaggtgtctctcactgggggagcttccaggatcctgagcagactggacacaatcatctctcccttcctctatgtcaagcactgttacaaaagactgtgagcaaatttccatctaaatattaataattctgaagaagaggcaaaactgttgaatgcaagcgatacctattgttgaagaaacccacaaatttctgattctaagatcaggggatacaacaaaatctacaagtcatttcaaatagcacacaggaatcaaactttggtaaatcatttctgaggcacaattaaatatattgtagcactatgttaattaattatattaaatgtcgattcatcttgaatgtattctcaattgcctaccaaaaattggtatgattatcatttctgggtctactgatttttcatcatggcaacagaaattgtcattaaatagaattaagatacaactatatatcttattatttaaaaacattcatagacatattcataaagtttgaatttaaagttttatttttgcaattcagttgtatagaaatgttacataaattcctaaatgctcaattcaggtggcatgatttttagaatattatcttcttcaagatgaatacttaggtctacttcagctctgatattctatttttactttcttacttgaagtgagaaaagagaatggtgaattgtattatagcggtaatacattatttttattttagcttagatttacatttatcagtaaaacgtgtcagtgggctgggtgcagtggctcacatctgtaatctcagcagtttgggaggctgaggtgggcacgccacttgagcaccggagttccagacgagcctggacaacatggcgaaaccccaaaaccccatctctacaaaaaatacaaaaattagctgggtgtggtgggacacgcctgtagtcccagctacttaggaggctgaggtacgaggatctcttgagtccaggaggtgcaggttgcagtgagccaatattgccccactgcactccagcctgggaagcagagtgagaccttgcctcaaaaaaaaaaaaaaaaaaaaaaaagtgtcaatgaagaaaggaaacaagactttttatagttgaaccaggcttattgtattttaaatccctgaagaagaattcttcatgttatcactcttgtacagaaagatataaagtgctcagcttattttgctgattttgaaaatcaaacactatctccttgccctaaaattatagcgtgtggctcatcctcttatcccacccagatttctatctggttggttagggtagtccatgcctcaaggaaggcggtgcagcttaatttaacatattgttcagtaaagaatcccattgtgtatcataagaatcccttatccttttcgggccctccaccataccagactgaaaagtattccattgtccagaagtagctggtcttgagatttttattttcaagtgtattttctgtgatgttgtctcattgttatggaatagtttaggataattttctgatctctacagtagcatgtgaagtcacaatttgttgccacttacattgattatctcctaacatgcatttggcactaaattatttttctctttagaagtatatgaagattctgaattaaaccattcattaatta

SEQ ID NO: 87 - DNA, 9205 bp, Homo sapiens
accagagccctcggaagtgtcaggcactgcggtgtattttccccgttctcttttaaatgactgcggaaaaacagattccgagccgcaaaagggaagacggattctcagacaaggcttgcaaatgccccgcagccatcatttaactgcacccgcagaatagttacggtttgtcacccgaccctcccggatcgcctaatttgtccctagtgagaccccgaggctctgcccgcgcctggcttcttcgtagctggatgcatatcgtgctccgggcagcgcgggcgcagggcacgcgttcgcgcacaccctagcacacatgaacacgcgcaagagctgaaccaagcacggtttccatttcaaaaagggagacagcctctaccgcgattgtagaagagactgtggtgtgaattagggaccgggaggcgtcgaacggaggaacggttcatcttagagactaattttctggagtttctgcccctgctctgcgtcagccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaagatttctcatggtttggatttgggaaagtaaaatcaagacaaggtgttggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatttgttcagcacatcaagcgacataacattgttctgaaaagggagctaggcgaaggagcctttggaaaagtgttcctagctgaatgctataacctctgtcctgagcaggacaagatcttggtggcagtgaagaccctgaaggatgccagtgacaatgcacgcaaggacttccaccgtgaggccgagctcctgaccaacctccagcatgagcacatcgtcaagttctatggcgtctgcgtggagggcgaccccctcatcatggtctttgagtacatgaagcatggggacctcaacaagttcctcagggcacacggccctgatgccgtgctgatggctgagggcaacccgcccacggaactgacgcagtcgcagatgctgcatatagcccagcagatcgccgcgggcatggtctacctggcgtcccagcacttcgtgcaccgcgatttggccaccaggaactgcctggtcggggagaacttgctggtgaaaatcggggactttgggatgtcccgggacgtgtacagcactgactactacagggtcggtggccacacaatgctgcccattcgctggatgcctccagagagcatcatgtacaggaaattcacgacggaaagcgacgtctggagcctgggggtcgtgttgtgggagattttcacctatggcaaacagccctggtaccagctgtcaaacaatgaggtgatagagtgtatcactcagggccgagtcctgcagcgaccccgcacgtgcccccaggaggtgtatgagctgatgctggggtgctggcagcgagagccccacatgaggaagaacatcaagggcatccataccctccttcagaacttggccaaggcatctccggtctacctggacattctaggctagggcccttttccccagaccgatccttcccaacgtactcctcagacgggctgagaggatgaacatcttttaactgccgctggaggccaccaagctgctctccttcactctgacagtattaacatcaaagactccgagaagctctcgagggaagcagtgtgtacttcttcatccatagacacagtattgacttctttttggcattatctctttctctctttccatctcccttggttgttcctttttctttttttaaattttctttttcttttttttttcgtcttccctgcttcacgattcttaccctttcttttgaatcaatctggcttctgcattactattaactctgcatagacaaaggccttaacaaacgtaatttgttatatcagcagacactccagtttgcccaccacaactaacaatgccttgttgtattcctgcctttgatgtggatgaaaaaaagggaaaacaaatatttcacttaaactttgtcacttctgctgtacagatatcgagagtttctatggattcacttctatttatttattattattactgttcttattgtttttggatggcttaagcctgtgtataaaaaagaaaacttgtgttcaatctgtgaagcctttatctatgggagattaaaaccagagagaaagaagatttattatgaaccgcaatatgggaggaacaaagacaaccactgggatcagctggtgtcagtccctacttaggaaatactcagcaactgttagctgggaagaatgtattcggcaccttcccctgaggacctttctgaggagtaaaaagactactggcctctgtgccatggatgattcttttcccatcaccagaaatgatagcgtgcagtagagagcaaagatggcttccgtgagacacaagatggcgcatagtgtgctcggacacagttttgtcttcgtaggttgtgatgatagcactggtttgtttctcaagcgctatccacagaacctttgtcaacttcagttgaaaagaggtggattcatgtccagagctcatttcggggtcaggtgggaaagccaagaacttggaaaagataagacaagctataaattcggaggcaagtttcttttacaatgaacttttcagatctcacttccctccgacccctaacttccatgcccacccgtccttttaactgtgcaagcaaaattgtgcatggtcttcgtcgattaataccttgtgtgcagacactactgctccagacgtcgtttccctgataggtagagcagatccataaaaaggtatgacttatacaattaggggaagctaatggagtttattagctgagtatcaatgtctctgcgttgtacggtggtgatgggttttaatgaatatggaccctgaagcctggaaatcctcatccacgtcgaacccacaggactgtgggaagggcagaatcaatccctaagggaaaggaaacctcaccctgagggcatcacatgcactcatgttcagtgtacacaggtcaagtcccttgctctgggctctagttgggagagtggtttcattccaagtgtactccattgtcagtatgctgtttttgtttccttcactccattcaaaaagtcaaaatacaaaatttggcacagcatgccaacgggaggctgtgcccagaccaagcactggaagtgtgcttctaggcatagtcattggttttgcaaaaagagggctcaaatttaaatagaaatttacagctatttgaatggtcagatataccaagaaagaaaaatatttctgttcctcaagaaaacttgctaccctctgtgaggggaattttgctaaacttgacatctttataacatgagccagattgaaagggagtgattttcattcatcttaggtcatgttatttcatatttgtttctgaaggtgcgatagctctgttttaggttttgcttgcgcctgttaattactggaacaccttatttttcattaaaggctttgaaagccaattctcaaaaattcaaaagtgcaaattaacagaacaaaaggaaatccagtagcaactgcagtcaagcgagggagttgacaagataaaccttacgtccattcaagttatatgctggcctatgagagatgagagttgggtcgtttgttctctttgttgatgattttaaaaaaaccctctagaatacacataataacataatgaaagccatatctccatgatatatatgtgcacatatatatacatacatgtgcatgtatgtatcatattaaggacccatggtactcttaaaacactgtagaactctgtgacgcagtaaggaaggggcagatttgtacaaaaacttttctagattccatcagcaaaaaccaacacaggtttgtcacgctgcatgtctggccagctaatctcgggggaaaagctacaagttatttattttattttaagagaataaagtaggtaataatttaagggatcaaattcaaggaggaatgtgcaattttagagcaaagatttgtttaaggcaaatgagactttgggagcatcccattccagttttgtcttttttttctctgaaagaaaaaagcaaaaaataaaataaaattccacttataccttctgacaagtccctaaaggtcttgaaataaaaggttctatgcaagtgcaaagttttatagttatttttattgctgattattactattactatctctgttgtcttaagagtatgtgctgatttcagagacatctcaaattgaaagaatatcagattgcttttaaagtagctgaacgagccacagaatatctgaaattattcattgttgttcctccaccaccccctttctcatggtctgatttttagaagagtggcatcctcgttctaaaatgtaatgatcaccaaatacggccttccatcaaatttgtgaaaactacaacagtataacagtgacaaacctaattctctagcccaaacctggtctgacaatcatttccatttagaagtcattgaatagttttccaaacactttccatgtgtgttagcaaattattcctattttgtgtagatgaggacgttgagactcagagacattcagaggcacgctagaggtctccagcctagcttccagcaccattgggactgaatccaagtactctcactctgaacttcgtggttctgtccactagagactctaatatgcaaacaagcagttcaggaaagaaagcatgctaacacattcatgaagcagtatatgaagttagaagaacaaaaggaaatacaggagatgacaagcaactgagatattgtgatatataatcatgctcttagcttcagctaaattcagctaaattcttgtacactgaaccaatgtcataatcaggcttatttagaaaacactttgaactatgctataaaagattatatcagaattcatattatacatgtgttcacatcagcgctacctgtgatgttttcatgtatttatgtatgtgttataaatacttgatttatacatatacaaatgcacatacgtagtgtgtttgtgtgtttatgtataaatttataggcacacaataatagaggtaattataagtaggatgcggtatgaataatttgcttaaaatatgctaaataaccaaaactgtttaacgtcatgttgctgttagtgcttccatactccacgtgggtaggactacatcacacttttcaactctgtgcagtactgcatgggtggaagacatatttaagataatgtgcttcccaaaacaactgaataaaagccatcccactacattgagtgctttctctggctccttgcaaagaaagatactttttgtaatggtccaggaaaggaacattgctttctttttgtctttcagcacatttgtattatgctcaccttgtctctgtctcactgtgacccctttacacttgagttcagagttcaagcattccaaatataaattggaatgttggcagcccagtggcttgaaggccaatgatgagcagtccaagaccccacagcgagatgagcaactcttaggaattcccacatcctagagtgaatgcaccaactaacagtatagaatgctgtccttttcaaagcgtcctaacagcaggattacctggtcaagtatggactttctttgaatctttcttttcacaaattggactgcctgtaataccaataacattgttgtatctaactaaataaatgactgcatatacacacataccctcaattctcttgcttccccattttctttttcatcccctgtctcaggacttttattttcaatgttgacctttggtttggccatatatcactgttataggaaatctcatgagaggaatggctagtgacccaactctccaaatgtctaagttagtagttacagctgattttttatgatgcataattggaatgtggagcctctgaggttgtgatagcttgtacatgaatttcaaatgtcattctaaagaatgaggggtgggagggatttatagttagaaacgacagtgcaggaaggggtattttcttgttgtcagggctggaatgaatcactgctgctcaagtcaaaggttcttgaatatccttagtttttgcatttcccctccttttcctttgacctttatttatttaattatgtatttatttatttatttatatacttttgctccattcagcacaaacacaaagcaaagcaaaaaaaaaaatatatatatatatatctgtatatgtgttgtaggcaaaacactgtgaatttcacaacaaccaccaccaagcaactattttgccatcttaacatacatctcaggagacgaaatgagaaaagatggggatgtcattttttagtctatgcgtttgaggccaggtccatgtttatttatttctttagtctatgcattaatgaaaatgatcctgagtggaggttagctgaacgttcaatgtactggagcaagcatcataaaagctgctagtagccatgtgtttgaacaggaaaaatattacagaaaatgaaatgtaaaggcctatatcttgcagcttgtatatcttactattgcttaaaaaatgtataaagcagctggaaatgttttaaatacaaggtctttgaattaaatgtggattttaaatatgtaatcccttgacaaatgaccaaattatggtgaactattgctccctgcgttctttgatcattacctatgacttacaaatctgcctggagatgtggacattctgcatttgcttctgtatctggagagatgtttgtatatatccaggccgtatacacacacatttccatatctctctacagatatatttccccttcaatcgtgacctggtatttggaactctccttttcatttggcttatcttccttttaatgtgatgtctctgtgctaatacttaccagttcttgttttgcaatctgttttgaggtccattgctttactaagacccactgcatcttggctgatttcaaagtgacacctgaatacagtgtttaaaaaaaaaaaagttttgtttgtaaatcatgtgaccagcttctctcaacctgacatggaaagtctcttgtactacagtgtatttaataaaaatgatgtcttacaataaataacatactccaaaagagagactaaaaatgaaaaaaaaaaaaaaaaaaaaaaaaa

SEQ ID NO: 88 - DNA, 3799 bp, Homo sapiens
agtcattcccctaactttcaacgtttacacaactcaggacacactctaggaaggaattcaatgattttcctctgggtggaggtattactaggttctaaagccgtggcaggcaagcagctaccaacggcgctaagttcaaagctgcccgagaactcgcccagagttaagtcagggaaaagaaacgcctgggaacaaacgcgccttctcccctgccccaggtgtgctaaaggacgatgccgcagatccctaactagctcagccttggagcgagcgctgggtgcctgcgatggaaagtcgctcttctcgccaagaatggtcgaaccccaaaacttcagggacgccgctcggagtaacttctcttcactcacttgcgatcagatgagaagaaagtaaagcccttccaacgtcaccctcagccggcgcgcggcagctgagtcccagcggggacggggtccgccgggtacccctccgcccgagccctgtgcgcttccaggtcctcctcctccgcgcggtcactggctgcatctccgccgccccggcacaatagaggctccgccctccttccgcgcgagctctccgcggctccctagcccagcagccctcgcccagcagcccgcgccgccaccgcctcttccctccccgtgtccggtccccgtgcgtcccgaggctccccgccgcccgtcccggcgcgcaccgcgggcgtctgtccgaacgccttccagccacctgagccctcctgcgggcgactcgctcagctagcccgtgcccgcctccaccttctccgtcatcccctcttccttgcgtccggctctccactggggctgcacagtcgagggctgctcgcgtcgggaaggagatgcccagagtctctggggcgcaccctcccgtcccgctcagccgcacccagctttagaaggtgctctcagcagccactttcgggctctagcgaggacaccctctcgcagaagtccttgccgagaccccccgccccagccattctctgaaggggctgaggacactcttatcgcgcccctcatggccaagcctcggctgctagttctctacttcgctctgattgtggttccggcctgggtgtccagcattgtcctcacagggacaagcgagcccccagatgcgcagacagtggcgcctgcggaggacgagactctgcaaaacgaggcggacaaccaggagaacgttttatctcagttgctgggggactatgacaaggtcaaggctatgtctgagggctcggactgtcagtgcaagtgtgtggtgagacccctgggccgggatgcctgccagaggatcaatgcgggggcctccaggaaggaagacttctataccgtggaaaccatcacctcaggctcgtcgtgcaagtgtgcctgtgtagcacccccatcggccctcaatccctgcgagggagacttcaggctccagaagctgcgggaggcagacagccaggacttgaagctctccacaatcatagacatgttggaaggagcgttctatggcctggatctcctgaagctacattcagtcaccaccaaactggtggggcgagtggataaactggaggaggaagtgtctaaaaacctcaccaaggaaaatgaacaaatcaaagaggacatggaagaaattcgaaccgagatgaataagcgaggcaaagaaaattgctctgaaaacatcctagatagcatgccagacatccgctcagccctgcagagggatgcagcagcagcctacgcccacccagagcagtatgaagagcggtttctgcaggaagaaaccgtgtcccagcagatcaactccatcgaacttctgcagacgcgacccctggctctgcctgaggtggtgaagtcacagcggcccctgcagaggcaggtccacctgagaggccggccggcctcccagcccactgtcatccggggcatcacctactataaagccaaggtctctgaagaagagaatgacattgaagagcagcaagatgagtttttcagcggtgacaatggagtggatttgctgattgaagatcagctcctgagacacaacggcctgatgaccagtgtcacccggaggcctgcagccacccgtcagggacacagcactgctgtgacaagcgacctgaacgctcggaccgcaccctggtcctcagcactgccacagccctcgacctcagatcccagcatcgccaaccatgcctcagtgggaccaacactccaaacaacctcggtgtctccagatcccacaagggagtcagtcctgcagccttctcctcaggtaccagccaccactgtggcccacacagccacccagcaaccagcagccccagctcctccggcagtgtctcccagggaggcattgatggaagctatgcacacagtcccagtgcctcccaccacagtcagaacagactcgctggggaaagatgctcctgctgggtggggaacaacccctgccagccccacgctgagccccgaagaagaagatgacatccggaatgtcataggaaggtgcaaggacactctctccacaatcacggggccgaccacccagaacacatatgggcggaatgaaggggcctggatgaaggaccccctggccaaggatgagcggatttacgtaaccaactattactacggcaacaccctggtagagttccggaacctggagaacttcaaacaaggtcgctggagcaattcctacaagctcccgtacagctggatcggcacaggccacgtggtatacaatggcgccttctactacaatcgcgccttcacccgcaacatcatcaagtacgacctgaagcagcgctacgtggctgcctgggccatgctgcatgacgtggcctacgaggaggccaccccctggcgatggcagggccactcagacgtggactttgctgtggacgagaatggcctatggctcatctacccggccctggacgatgagggcttcagccaggaggtcattgtcctgagcaagctcaatgccgcggacctgagcacacagaaggagaccacatggcgcacggggctccggaggaatttctacggcaactgcttcgtcatctgtggggtgctgtatgccgtggatagctacaaccagcggaatgccaacatctcctacgctttcgacacccacaccaacacacagatcgtccccaggctgctgttcgagaatgagtattcctatacgacccagatagactacaaccccaaggaccgcctgctctatgcctgggacaatggccaccaggtcacttaccatgtcatctttgcctactgacacccttgtccccacaagcagaagcacagaggggtcactagcaccttgtgtgtatgtgtgtgcgcgcacgtgtgtgtaggtgggtatgtgttgtttaaaaatatatattattttgtataatattgcaaatgtaaaatgacaatttgggtctatttttttatatggattgtagatcaatccatacgtgtatgtgctggtctcatcctccccagtttatatttttgtgcaaatgaacttctccttttgaccagtaaccaccttccttcaagccttcagcccctccagctccaagtctcagatctcgaccattgaaaaggtttcttcatctgggtcttgcaggaggcaggcaacaccaggagcagaaatgaaagaggcaagaaagaagtgctatgtggcgagaaaaaaagttttaatgtattggagaagttttaaaaaacccagaaaaacgctttttttttttaataaagaagaaatttaaaatcaaaaaaaaaaaaaaaaaaaaaaaaaa

SEQ ID NO: 89 - DNA, 1857 bp, Homo sapiens
gagagagacccagagatcaggagagaaggcaccgcccccaccccgcctccaaagctaaccctcgggcttgaggggaagaggctgactgtacgttccttctactctggcaccactctccaggctgccatggggcccagcacccctctcctcatcttgttccttttgtcatggtcgggacccctccaaggacagcagcaccaccttgtggagtacatggaacgccgactagctgctttagaggaacggctggcccagtgccaggaccagagtagtcggcatgctgctgagctgcgggacttcaagaacaagatgctgccactgctggaggtggcagagaaggagcgggaggcactcagaactgaggccgacaccatctccgggagagtggatcgtctggagcgggaggtagactatctggagacccagaacccagctctgccctgtgtagagtttgatgagaaggtgactggaggccctgggaccaaaggcaagggaagaaggaatgagaagtacgatatggtgacagactgtggctacacaatctctcaagtgagatcaatgaagattctgaagcgatttggtggcccagctggtctatggaccaaggatccactggggcaaacagagaagatctacgtgttagatgggacacagaatgacacagcctttgtcttcccaaggctgcgtgacttcacccttgccatggctgcccggaaagcttcccgagtccgggtgcccttcccctgggtaggcacagggcagctggtatatggtggctttctttattttgctcggaggcctcctggaagacctggtggaggtggtgagatggagaacactttgcagctaatcaaattccacctggcaaaccgaacagtggtggacagctcagtattcccagcagaggggctgatccccccctacggcttgacagcagacacctacatcgacctggcagctgatgaggaaggtctttgggctgtctatgccacccgggaggatgacaggcacttgtgtctggccaagttagatccacagacactggacacagagcagcagtgggacacaccatgtcccagagagaatgctgaggctgcctttgtcatctgtgggaccctctatgtcgtctataacacccgtcctgccagtcgggcccgcatccagtgctcctttgatgccagcggcaccctgacccctgaacgggcagcactcccttattttccccgcagatatggtgcccatgccagcctccgctataacccccgagaacgccagctctatgcctgggatgatggctaccagattgtctataagctggagatgaggaagaaagaggaggaggtttgaggagctagccttgttttttgcatctttctcactcccatacatttatattatatccccactaaatttcttgttcctcattcttcaaatgtgggccagttgtggctcaaatcctctatatttttagccaatggcaatcaaattctttcagctcctttgtttcatacggaactccagatcctgagtaatccttttagagcccgaagagtcaaaaccctcaatgttccctcctgctctcctgccccatgtcaacaaatttcaggctaaggatgccccagacccagggctctaaccttgtatgcgggcaggcccagggagcaggcagcagtgttcttcccctcagagtgacttggggagggagaaataggaggagacgtccagctctgtcctctcttcctcactcctcccttcagtgtcctgaggaacaggactttctccacattgttttgtattgcaacattttgcattaaaaggaaaatccactgctcaaaaaaaaaaaaaaaaaaaaaaaaa

SEQ ID NO: 90 - DNA, 2111 bp, Homo sapiens
agagggcgtcttcacgcaggcaccgagaagctcccactagtgtatgccttaatggtgccgctcttgtccgcgtctacgcttgggaccttggcttctgacttggagagtgtacagctctgcccgacggcaacccagcttgggaagagaagccccagcgtgggctggggctcaaggcgcaggaaggccgagcccggcgcggacgcaggcggctccgggcgggctcagcacccccaggcaccgtctcctagtgaccgcggcgctcgcgggcctggcggccgttgtccgggcgactgcgcagcgcgggcacccccgcggcccctcccctgggcgcgcgcgcgacctgggtgccatggcggcagcggcggtgacaggccagcggcctgagaccgcggcggccgaggaggcctcgaggccgcagtgggcgccgccagaccactgccaggctcaggcggcggccgggctgggcgacggcgaggacgcaccggtgcgtccgctgtgcaagccccgcggcatctgctcgcgcgcctacttcctggtgctgatggtgttcgtgcacctgtacctgggtaacgtgctggcgctgctgctcttcgtgcactacagcaacggcgacgaaagcagcgatcccgggccccaacaccgtgcccagggccccgggcccgagcccaccttaggtcccctcacccggctggagggcatcaaggtggggcacgagcgtaaggtccagctggtcaccgacagggatcacttcatccgaaccctcagcctcaagccgctgctcttcgaaatccccggcttcctgactgatgaagagtgtcggctcatcatccatctggcgcagatgaaggggttacagcgcagccagatcctgcctactgaagagtatgaagaggcaatgagcactatgcaggtcagccagctggacctcttccggctgctggaccagaaccgtgatgggcaccttcagctccgtgaggttctggcccagactcgcctgggaaatggatggtggatgactccagagagcattcaggagatgtacgccgcgatcaaggctgaccctgatggtgacggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagagggtgctgcgcctcactcgcctgtcgcctgagatcgtggagctcagcgagccgctgcaggttgttcgatatggtgaggggggccactaccatgcccacgtggacagtgggcctgtgtacccagagaccatctgctcccataccaagctggtagccaacgagtctgtacccttcgagacctcctgccgctacatgacagtgctgttttatttgaacaacgtcactggtgggggcgagactgttttccctgtagcagataacagaacctacgatgaaatgagtctgattcaggatgacgtggacctccgtgacacacggaggcactgtgacaagggaaacctgcgtgtcaagccccaacagggcacagcagtcttctggtacaactacctgcctgatgggcaaggttgggtgggtgacgtagacgactactcgctgcacgggggctgcctggtcacgcgcggcaccaagtggattgccaacaactggattaatgtggaccccagccgagcgcggcaagcgctgttccaacaggagatggcccgccttgcccgagaagggggcaccgactcacagcccgagtgggctctggaccgggcctaccgcgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcgagccgccgggcccgacaaactccgggtcggcgaaaaaaaaaaaaaa

SEQ ID NO: 91 - DNA, 5480 bp, Homo sapiens
agcttaacaagaccatggcctctggacccgcgatcagctcgctgtgtggtcctgagcagccacccaacatctctgggccttggattcctacctggcctttcttctggatgcatcatttttgcctttaggtatctggaccattcccccccatggatgataaagtctttgcttcacaccctcaggattaccttaaaggcctgaaaagaacagaggaggagtctgaggaggtgaattccagccgtgctcttgcaggctggctgggcagtgtgctggggaggagagggagcctctggctgggcctcctccaccgggcctggtgtgctgggaacaccccgcattgtcccaaggcctcagatttgactttcaaagggaaaacagctctcctgataaaggacaccattggagaaactgggcattttaccaaggatttgactggaatggcatgcttcctttaaagatgaaagttgacttttagagccaattaaagccctttggggaatctggcctcataccttgtccacacagagttcctgtacaaggttcctgacctgtgggaagcggcacagcaccagctaggcagagacgccccaggccatgttagagctttgagtgaggcctggtaacagggaggcgctgtcacctactggccttgccaatccagctccaagatgctgagcctgaagctccccaggctgtttagcatagaccagataccccaggtgttccatgagcaaggcatcctgttcggctaccgccatccacagagttctgccactgcctgcatcctcagccttttccaaatgaccaatgagactctcaacatttggactcacttgctgcccttctggttctttgcatggaggtttgtgactgcactgtatatgacagacatcaagaatgacagctactcctggcccatgcttgtgtacatgtgcaccagctgcgtgtacccacttgtgtccagctgtgcgcacaccttcagctctatgtccaagaatgcccggcacatttgctacttcctggactatggtgccgtcaacctcttcagcctgggctcagccattgcctactctgcatacacgttcccggatgcgctcatgtgcaccactttccatgactactacgtggccctggctgtactgaacaccatcctcagcacaggcctctcctgctactccaggtttcttgaaatccagaagcccagactctgtaaggtgattcgtgtcctcgcctttgcttatccgtacacctgggactccctccccatcttctacaggctattcctgttcccaggggagagtgcacaaaatgaagccacctcgtaccaccagaagcacatgatcatgaccctcctggcctctttcttgtactctgcacatctgccagaacgcctagcccctggacgctttgactacatcggtcacagtcaccagctgtttcacgtgtgtgtgatcctggccacgcacatgcagatggaagccatacttctggacaagactctgaggaaggaatggctcctggccacctccaagcccttctctttctctcagatagctggagccatacttctgtgcatcatcttcagcctcagcaacataatttatttctcagctgctctgtatcggattcccaagccagaattacataaaaaagaaacatgactcagaccataagcttttcatgccagatgtcaacattaagctgcaacatcctaaccaccataagccggaggtggttacagcttatcatggcctaaaatattcataatggttggtgtcttttgaatgaattcatgtcaaaaatgttattcagctggggaaatttctctaaatgtacactgattctgtgtgtgtgattttaaaaggagaatatggttcaagcaagtccttgttaaggcaaactattgatatttcattaattttaaatttacttaaaatgtggttttaaattctatttaaacatttggattaagcatattactctggagctttgtattattctttaaaaatgaatcttgcttcatttgatgaatttcatgtcacaaagcttctctcaagagctctcgtagtggcctgtcaaccactttcggagaatgagccaggtcagtcactgggaggacctgtgaaagaaagttggtcactgagtgccttggggactggcaaaacattccagaatgaagagagctgtctggggagagcccttcttcccttctccacctagtgaagggagaacagaaggggagtcctctcttcccacaagtccattctgccttcaaagtgtaagttctcatgtcattatggatttggagtttgtcagtttttttcttaaaagtccacagcggggtgtcatgtgttctgttatgttctgttttctggttgccagtttgatctgcaaagtatttttcagtgcaggtaaaatgtgttaaaccataagagttgactgagttaatcccaattggttgtgctcatatgccaccttttaaaccaatggaaattgctatatttggggatgtcatacatttgatattgcttcagcatttcaaatatgttgcaaaatttagtatccatatgcataagaagttaatcaccttgccagtggggtggtcacatatagtgttctcaagctttactgtgaatcagaaacatccagtaagcttgtgacaaatgcagactcctagggaaaaccagggggttctgcttcactaggttaaatgtaggttttgtagaggagatctgcactggagcaagtctcccagatgattctaatacaggagggccagaggccaaacttgaagaactgctggtgttacatgttccaaaaggcattagacctatcagctttgtttcgcctgatctcaagttttagcaactcaccaactaaggcgtaacctcattttatgttccagcgttttctactctgaatagttctaaaacactgagcattttctcatttgttgcattactgattaaagttcagtatttcatggtgttttcagggaacacagaaatgcggatgcaaaacaacttttgacagaggcccatcaaacccagatctgcacttggtaatgacttaggggggcttcctcacaatgcaggatcctctttgctgactcaggaatactccatattttagactactgcctctaccattaactagcccagacatttgaatggccttgtaaacagctcactgtctaatactcgaaggacaagtaacaatttatattggatgagagtggtcaagaaatatgatttcgttagttttattatctgtttacttcctctggggaaggcagactgataaaattatatgggctggtaaatttttggtacattaattgcaagctgcatgacaaaatttgtttttctggcaacaatctgacattattagtggaattccacaccaacagggcttgtgagcttccatttcatcttactgtaacttcaattttatggcaaaaaaaggtacaaagtttaaatacccctttctagtaatgccaaagacatacagtgttttacattctctcctttataggtaacaaaataatgtttagctcagtaagtactgaaataatgagtgaccaatttgaaggatttttagattatttaatctttgcttatgttgctttttcacatgcttaatgatggaaatgaaatgttaaatcaacaaaataagatccagtgtttcataacatttttataagtttggtaaactttagtcccattatatacttttggggacagtgttataaatcagaattttacgacagtttgcagaacactgatttgaaagcttcctatgcaaaatgagaaggggttcaaatatattaattatcattaagtattaaataataggcattagatgtctaatgtgagtataatttcatccaagccatctcagaaagtctaaaaggttggcagggggtcagctgaagacctcactggagtgggtcttaatttttaaaaagtgtctcactacatttaagacatgtgacacattcccattggtaacaattgctcaccatggcattgtctcaaaaaagactatggtggggagggtggcacattcctaatgggatgtacctctccccactccccttgcttgagaagcactactcaaaaatttaccagaccttacaactgtgataaaacttgaatgtgtatgatgaataaggccattcagttaactttacctccctttacccattgaaggggttccttttccattgctcagtttttagaaaataattctcatcttttttctaaagaaatgaatttgtggctggtctgaaggtagtgagttagctcaattgattgttcgcagtcagttatagatcaagctccttgttctactcttcccctcttctcactactgcacttgactagtcttaaaacaaagaaagaacgaatgaatgaatgaatctgtggctggatgcagtggctcatgcctgtaatcccagcactttgggaggctgaagtgggaggactgcttgggcccaagaattcaggaccagtctgggcaacagagccagacactgtctctataaaaaaaagttaaaactagctggttgtggtggtgcacacctgtggtcccagctactgtggagggtgatgtgggaggattgcttgaacccaggagttggatgctgcagtgagctatgattgcgccattgcgctccagactgggcaacagggcaagaccctgcctcaaaaaaaaaaaaaaaagaatttgtaattgttggtaggatgttatgggaaatttagaggtcttctgagtataaagtggtttaaatatttggtctgctgaagtctttctggaagtgttgttccccctgctgccccgcccagtagaaacttgctcatatgagaggttctgaggtaggtgcggtgtagtagaatggcattgtcagatatgttcaagaaacccttcatttgacactattttgtaccttatggtaccctttaacattttttaattaaaaaaaatattttttgagacagggtcttgttctgttgcccaggctggagtgtagtgttgcaatcttggctcactgcaacctctgcctgacaggcttcagtgatctttccacctcagcctcctgagtagctgggactacaggtgcatgccaccaagcctggctaactttttgtagagatagggttttgccatgctgcccaggctggcttagaattcctgaattcaagtgatttgtctgcctcaggctcccaaagtgctgggattacaggcatgagccacactgcacccagtccatgctaccctttttatatgaaacacctattaacacggtacaacaacacttcaaaacatattatttgaatttcggcctctgattttctagtcaacaatccattaaggcaaagacctgtttccaaactcagatgttctccaacttacactaatgtctggttttcttgaactatgtgagagaaaaaaataaacagaatttatttattataaaa

SEQ ID NO: 92 - DNA, 3812 bp, Homo sapiens
gggcctactctgccgccgccgccgcccgcccgctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctctttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgaggtttctcctctgcctcctacttaaaggtccatgttaaaacccaccacggtgttccccttccccaggtctccaggcaccaggagcccatcctgaatgggggagcagcgttccactgcgccaggacctatggcaacaaagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcgggggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgaagggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacattactcta

SEQ ID NO: 93 - DNA, 6918 bp, Homo sapiens
aaagtttgcattgcaatccccctgccttcctctcctttctcccgatcaatgcatatttgcaaaaggattaagccacagatttaagcgccgggagcccatttctgccttgcaaaggagaccggactgaaaaacctaaagccagctctgatttcttttcgccaagtgggaaggtggtttatttttcttgctttttggagtcaacacccttccccaccagcccttatccccaccctcaccccgcaaccccttcacgccccctccccctccccctcctcatcctcccaccatcctctaaagaggcaaagggattttttttttcttttggtcttcttttttcccccttccctgtttatcctgaaaaggatttgaagacaagcttgaaggataaaaagccttggtgcttcccaggagccgagccgaggagcagaagaggaagagccgggggctgccgtagcctttggagatggacgagcagcccaggctgatgcattcccatgctggggtcgggatggccggacaccccggcctgtcccagcacttgcaggatggggccggagggaccgagggggagggcgggaggaagcaggacattggagacattttacagcaaattatgaccatcacagaccagagtttggatgaggcgcaggccagaaaacatgctttaaactgccacagaatgaagcctgccttgtttaatgtgttgtgtgaaatcaaagaaaaaacagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggttcttccagttcttttaacatgtcaaactctggagatttgttcatgagcgtgcagtcactcaatggggattcttaccaaggggcccaggttggagccaacgtgcaatcacaggtggatacccttcgccatgttatcagccagacaggaggatacagtgatggactcgcagccagtcagatgtacagtccgcagggcatcagtgctaatggaggttggcaggatgctactaccccttcatcagtgacctcccctacagaaggccctggcagtgttcactctgatacctccaactgatctcccagcaatcgcatcccggctgaccctgtgccccagttggggcaggggcaggagggagggtttctctcccaacgctgaagcggtcagactggaggtcgaagcaatcagcaaacacaataagagtctccttctcttctcttctttgggatgctatttcagccaatctggacacttctttatactctcttcccttttttttctgggtagaagccacccttccctgcctccagctgtcagcctggttttcgtcatcttccctgcccctgtgcctctgtcctagactcccggggtccccgccctctctcatatcactgaaggatattttcaacaattagaggaatttaaagaggaaaaaaattacaaagaaaataataaaagtgtttgtacgttttcatgctggtggtttgaggagccaaatttacctcactcgaatccctcactccctatgttaacaggcaatccttctctgtttctcttattactctcactacctcttagcaggaatactccacattgccctattcattccaggcctccctgcttcctcttgctcttcctccctggggacagtactgattggaacactttcctcctcttccttcctagccccagctattcactggggactgtcatagctgggattctaaaggtgccacatttttcagtttcatctccactaggttggttcccgggcaggaagtcaggcagcagggaaggacacgggaacagcaggtggagaattcctacagtctttcttaccctgctagcaatagctctcagtttcagaggcacagtctttggagaccattcagcactgagaaagcaatatttagaacctattgcaaaactgggcctgagttaggcatggtgatgaatgcatcagcaaggaatagaaagttcttatcgtgaaacccttcaacctcaactatgccttcatagacacacacgttcatgcacatgtaggcacatgtaccatctcacatcttcactttcccgagatgccatatacaattacctacattaataactgtagcactatgccttttgagcccgagagagggaattagtgactctaagtgaaggtcactgacacagagaagcagtatgtgtctggggcttccaggacctgcaggcccactagcgtgcacttaccagaatggcatacacaggacctgatcatgaggaagaccaggtttccagtgtaaactactcttgttcccaccacctctggagcactcagggagccccatacagtacttacaatgtctttaatggacttgattctgtttaattttttgttttatattaggcacactgtattaattttccaaaatgttataccacactatgttcttggtcctgacctattgctctggaggaaagagttgtataagaacgtggctcatgtgaacttttgctagcttcatttgaggacctgagaatcatggggaaagggaaggtaatgttttcattgaaatcatcacagtgatttttattccctgggaacacagcgtgtactaaaaatacatgagaaaatagcatgtatatgaaagctattctcaaaagtcacctgagctcaccatcttcatagccaaccctaccagttataaagatggcagctctatcacttgattaagtgggaggtggtcaaatattttggtgcctcattttcttcatctgtgagatgggaactgttatgcctggcttactaagagtcttgtgagagactgagaagttgattttgttcatatccaatctgtaaatgcgaagtcaggggaagtaatgtccctgaaataaacgggttcatgccatctagggacaataaatggttttcttgttgtaacttctggttaatatcagtaccttgatgtcatcaccgtgatgacaaagagaagagttattgttgatcttcttggttttggtctgtctcttttcttaggataaagaaaaacttccaaactagaaaaacaggccctggttcccttagtttgcacttgaacccaatatgttgccttgtacatacttggtccctgtcacattgactgcttgggaggcttccagggagaagtatgagaccctgaggggtgagaatgggcagctagcaagaacatggaaattctgcttggcactacagtcataaatagaaaacactgtgtgtgctcaggggagcaggggatgccactgaagaaactcaagggaatgtgtatttgaaggaaatgcaaaaactaagtatttagcaaaatgaaattatgccttgatgactaaaaggcactagaaaggttgtgtctactaacttcagccctaatcagaacagatgcctagaaggagcatttttgtgacaacttcatagtgattagaatcagtggagaactccatcttagtggcaggaatataatgaaactacccacgcaagaacatggttgaatcacatttgcttgacttagggcaaagtacgaaagagagacaaaagggttctcttggaaacaagaagagtgactccagatgtggcctgaataattgccatgttaagttaatgcaaaagatcagaacagggctacatttgcacaggcagtttctctccgggccgtagttttcactgatgatcacctttcacagcattttccccaaccagcatttcacttagtcttctctatacccagcacctcccccggcacccccggcaagcccactatcacttccgacttccaacgtggcatccgtgagatctgtccacattaggcgaagcaggagaacactgagagcagcaggatgggtttggaaagagcatgcctctggaaacacagcttcctgggaattcacatgaggccagtcctacagagagcaagatgcaccccaggatttcttcattttctaatagatgtgggagtgctccattttccccgacagcgaatttcccctgagaaacgatactagaccctgggtttgcccaccttgtaactcttccttatctcctccttttcatccctaatccatcctccctctggcatggaattgacgcccgtgcagtacatttgccaagtggcaccttctttcaatttatgttttattttgctatggtggtgattctttatttgctggttgtcttttctcacacatctttctctctgtctctctctttcctgctctttgtttttctgcccagaaaaacctgacttcgataccaaaaaagatgaaactacagaaactcaaatttaaaaaaaactttaaaagaaacaaaaaaatactcaacgattctttcagctttattaacattttccattgtttcttgcgacttgtgtctcgttctttgtagtattgatgatgaacatttgataatgaatgttcttgtatattcagataaagaaaaaaaaaaccaaaaaagcggtctgaatttaatagtgtttataataaaaattttaaaaatgaccctcatagcacgcaaaacaggatggggaatttcccctcttctttctgtgacaatgcgcatcattcctgcattagtttttaacaccagactacctacattcatcatttccctcatttttcttttattttcttgcatttgtgaattagttcaagaatgctagaaaagtgtcgagttgtgcacatccatttcttgtttcacaatgtttaaaagtgacagtaattcattttgtaaactaaaaaaaaaaaaaaaaaggttggaatagtgagcataataggtacaacctaacacattattatgtttattaactttgagacccagaaataaattcttttcttttcttgattcttgctcttaaaaatacaaaaaaaaaaatgttttgttttgtgttatttttggtttgtttattggggggctttttttaattgtcaggattatgatcttgctgtttttcttcaatatgtatacaaggtgatgtgaaaagatgacttgggcagaggagtaagaacaagtaggcttgttcttctactttgcttcagaattcagttaatgccaaaagcgaagatcaagcccatgttgatgtctcgttgctcacctgcatttccagagagtgtgacactcatgcagtccctgagaaaaataaaatcagggacatacttctccttttagccttttaaaaattcaaaaacgtttagtccaagggaactttttatgctatcaggaaaggtttttgctgtttttgattctgattatcacagccaagtactttgttttatttctccctaattaataactacattccatgaggcctcttccaaccaaagaggccttttcttccaggagagtcccgcaggagatgctggtatgatgggcaccattggttaagtaaactacatgcaggaagaagtccttggggccagtctgccagctgagtcctggttttggatgaagagttaatgagatattgggccaggctcaatgctgtagttttaatgctaagaggttacgtttacttcacagagtacacctcttagtaacctctgacttaggcagctgcttaaagcaaattgcaaaactggcttgatttggaatgtttttattagaggaaaaaagaaagccatattatctggaaaaaaattcattttaaataccatcattcaacaaattatgttcagaaagtggtcagaacttaagcaagaaaagtaaagaaagaatgcagaattgtggagcaatgctttaggaaatatttctacctgaacacttgtactcttgaagtcacaacaaaataatgatgagcttttcacatcacctttatggtttcaatccctagctcaaagcttcctggaatcttttattttttgtaaacttttttttcttttgttaaaataaataaaacattcaatgtttttctccttttctctcttattacttctttcctttggcattttcaatttgaaatgctttcctttggttgttggttttattctccccctacccctccccttttcttattattcagaatataaacctgcaaagctctgctctgttttggttttgaaagtttaagcttttctgcttctgtgagagcacaggcttctgtcccttttgattccaactgaacttttgtgttctctaatgatactaacacggtgtaggttttacagtctcctaatttgtactggtaatgcatattccaaataaatagtttcttttgttgcaaaaaaaaaaaaaaaaa

SEQ ID NO: 94 - DNA, 1651 bp, Homo sapiens
gacctagagaggtcccaggacacgccactgtcccgccttccccattgcccgccccactggccagtccccacgcccacacacccaaggctgccccatctggcgctgattatcctgctgctgccgccaccgctgctgctgctctgcaaaattcagctgctgcctctgtcttgaggaccccagcgcctttcccccggggccatgctgcctgcagccacagcctccctcctggggcccctcctcactgcctgcgccctgctgccttttgcccagggccagacccccaactacaccagacccgtgttcctgtgcggaggggatgtgaagggggaatcaggttacgtggcaagtgaggggttccccaacctctacccccctaataaggagtgcatctggaccataacggtccccgagggccagactgtgtccctctcattccgagtcttcgacctggagctgcaccccgcctgccgctacgatgctctggaggtcttcgctgggtctgggacttccggccagcggctcggacgcttttgtgggaccttccggcctgcgcccctagtcgcccccggcaaccaggtgaccctgaggatgacgacggatgagggcacaggaggacgaggcttcctgctctggtacagcgggcgggccacctcgggcactgagcaccaattttgcggggggcggctggagaaggcccagggaaccctgaccacgcccaactggcccgagtccgattaccccccgggcatcagctgttcctggcacatcatcgcgcccccggaccaggtcatcgcgctgaccttcgagaagtttgacctggagccggacacctactgccgctatgactcggtcagcgtgttcaacggagccgtgagcgacgactcccggaggctggggaagttctgcggcgacgcagtcccgggctccatctcctccgaagggaatgaactcctcgtccagttcgtctcagatctcagtgtcaccgctgatggcttctcagcctcctacaagaccctgccgcggggcactgccaaagaagggcaagggcccggccccaaacggggaactgagcctaaagtcaagctgccccccaagtcccaacctccggagaaaacagaggaatctccttcagcccctgatgcacccacctgcccaaagcagtgccgccggacaggcaccttgcagagcaacttctgtgccagcagccttgtggtgactgcgacagtgaagtccatggttcgggagccaggggagggccttgccgtgactgtcagtcttattggtgcttataaaactggaggactggacctgccttctccacccactggtgcctccctgaagttttacgtgccttgcaagcagtgcccccccatgaagaaaggagtcagttatctgctgatgggccaggtagaagagaacagaggccccgtccttcctccagagagctttgtggttctccaccggcccaaccaggaccagatcctcaccaacctaagcaagaggaagtgcccctctcaacctgtgcgggctgctgcgtcccaggactgagacgcaggccagccccggcccctagccctcaggccttctttcttatccaaataaatgtttcttaatgaggaaaaaaaaaaaaaaaaaaaaaaaaaaaaaaaaa

SEQ ID NO: 95 - DNA, 5702 bp, Homo sapiens
tgctatccaccccagctggaatttagaccagacttacaggctttctgctccttccttcagtgaagaagagtctccagggtccctctagtgcaggtcaaagaagtccagtccagctgagttcagctccctagggcctccccagccagtctcctggaccaagagctggctttgcaagaaaacatcctactaaagccctgggaaaagagacaaatggtgaagaggagaatgaaaggttgcaggagggagctcctgttttagccctgccacctacctgggggccctctggctaccagtgtccttggaggggcttccttgctgcttctcccactaaggagctctggagccttaggaccatggacgctctcaataggaaccaaataggccctggatgccagacccagaccatggtgcagaaaggacccttggacctgatcgagacaggcaaagggctgaaagtgcaaacggacaaaccccacctggtgagcctgggcagtgggcgactcagcacagccatcaccctcctgccgctggaggaagggaggacggtgattggctctgcagccagagacatctcactacagggcccaggcctggctccagagcactgctacatcgagaacctgcggggcaccctcaccctctacccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagagatggagaagctgctgctccctgctgtagacttagagcagtggtaccaggagctgatggccgggctggggactggccccgctgcagcctcccctcactcttctcccccgcctctgcccgccaaagcttcccgtcagctgcaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaagggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccagcgcgagtggtctggacatggggaagatcgaggagatggagaagatgctgaaagaggctcatgcagagaagaaccggctcatggagtcgagggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagaagaggtttttccgcttcactatggtgactgagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaagtgagtggaa

SEQ ID NO: 96 - DNA, 1576 bp, Homo sapiens
agttaaaaacagatttcccacaagaccgaccggagcgccgatcagagcacctgcccgggccacacatttcctcctggagcacagcaagtgccgcctaaattacccgagtgagcatctcttcccggcacgagaggcagggaggccaaagggccgccaagctggcctgggagaggcgtagggcggagcgagagtggagtgacattcccgagggcggagccccagggcctccgagacccgtagactcccgcctcccgcctcctctaggccgccggccgcgaagcgctgagtcacggtgaggctactggacccacactctcttaacctgccctccctgcactcgctcccggcggctcttcgcgtcacccccgccgctaaggctccaggtgccgctaccgcagcgtgagtacctggggctcctgcaggggtccactagccctccatcctctacagctcagcatcagaacactctctttttagactccgatatggggtcctccaagaaagttactctctcagtgctcagccgggagcagtcggaaggggttggagcgagggtccggagaagcattggcagacccgagttaaaaaatctggatccgtttttactgtttgatgaatttaaaggaggtagaccaggaggatttcctgatcatccacatcgaggttttgaaacagtatcctacctcctggaagggggcagcatggcccatgaagacttctgtggacacactggtaaaatgaacccaggagatttgcagtggatgactgcgggccggggcattctgcacgctgagatgccttgctcagaggagccagcccatggcctacaactgtgggttaatttgaggagctcagagaagatggtggagcctcagtaccaggaactgaaaagtgaagaaatccctaaacccagtaaggatggtgtgacagttgctgtcatttctggagaagccctgggaataaagtccaaggtttacactcgcacaccaaccttatatttggacttcaaattggacccaggagccaaacattcccaacctatccctaaagggtggacaagcttcatttacacgatatctggagatgtgtatattgggcccgatgatgcacaacaaaaaatagaacctcatcacacagcagtgcttggagaaggtgacagtgtccaggtggagaacaaggatcccaagagaagccactttgtcttaattgctggggagccattaagagaaccagttatccaacatggtccatttgtgatgaacaccaatgaagagatttctcaagctattcttgatttcagaaacgcaaaaaatgggtttgaaagggccaaaacctggaaatcaaagattgggaactagtggaaagcggaagagcaggtcttgatgtgtcctagaattttgccatttctgagattgagccattgaaggcattccatttctaaagcttatttagccggtgcttctaaagaattccacactaacgtgataacatggtttttgtaacaataaatgtaggatatttcctggcacatgcaaataaacctaatcattgtttctttaaaaaaaaaaaaaaaaaa

SEQ ID NO: 97 - DNA, 2879 bp, Homo sapiens
ggtgaggctggctgggcggggacttcagggagagggcctcgagggacaggacgtgaagatagttgggtttggaggcggccgccaggcccaggcccggtggacctgccgccatgcaggacggtaacttcctgctgtcggccctgcagcctgaggccggcgtgtgctccctggcgctgccctctgacctgcagctggaccgccggggcgccgaggggccggaggccgagcggctgcgggcagcccgcgtccaggagcaggtccgcgcccgcctcttgcagctgggacagcagccgcggcacaacggggccgctgagcccgagcctgaggccgagactgccagaggcacatccagggggcagtaccacaccctgcaggctggcttcagctctcgctctcagggcctgagtggggacaagacctcgggcttccggcccatcgccaagccggcctacagcccagcctcctggtcctcccgctccgccgtggatctgagctgcagtcggaggctgagttcagcccacaacgggggcagcgcctttggggccgctgggtacgggggtgcccagcccacccctcccatgcccaccaggcccgtgtccttccatgagcgcggtggggttgggagccgggccgactatgacacactctccctgcgctcgctgcggctggggcccgggggcctggacgaccgctacagcctggtgtctgagcagctggagcccgcggccacctccacctacagggcctttgcgtacgagcgccaggccagctccagctccagccgggcaggggggctggactggcccgaggccactgaggtttccccgagccggaccatccgtgcccctgccgtgcggaccctgcagcgattccagagcagccaccggagccgcggggtaggcggggcagtgccgggggccgtcctggagccagtggctcgagcgccatctgtgcgcagcctcagcctcagcctggctgactcgggccacctgccggacgtgcatgggttcaacagctacggtagccaccgaaccctgcagagactcagcagcggttttgatgacattgacctgccctcagcagtcaagtacctcatggcttcagaccccaacctgcaggtgctgggagcggcctacatccagcacaagtgctacagcgatgcagccgccaagaagcaggcccgcagccttcaggccgtgcctaggctggtgaagctcttcaaccacgccaaccaggaagtgcagcgccatgccacaggtgccatgcgcaacctcatctacgacaacgctgacaacaagctggccctggtggaggagaacgggatcttcgagctgctgcggacactgcgggagcaggatgatgagcttcgcaaaaatgtcacagggatcctgtggaacctttcatccagcgaccacctgaaggaccgcctggccagagacacgctggagcagctcacagacctggtgttgagccccctgtcgggggctgggggtccccccctcatccagcagaacgcctcggaggcagagatcttctacaacgccaccggcttcctcaggaacctcagctcagcctctcaggccactcgccagaagatgcgggagtgccacgggctggtggacgccctggtcacctctatcaaccacgccctggacgcgggcaaatgcgaggacaagagcgtggagaacgcggtgtgcgtcctgcggaacctgtcctaccgcctctacgacgagatgccgccgtccgcgctgcagcggctggagggtcgcggccgcagggacctggcgggggcgccgccgggagaggtcgtgggctgcttcacgccgcagagccggcggctgcgcgagctgcccctcgccgccgatgcgctcaccttcgcggaggtgtccaaggaccccaagggcctcgagtggctgtggagcccccagatcgtggggctgtacaaccggctgctgcagcgctgcgagctcaaccggcacacgacggaggcggccgccggggcgctgcagaacatcacggcaggcgaccgcaggtgggcgggggtgctgagccgcctggccctggagcaggagcgtattctgaaccccctgctagaccgtgtcaggaccgccgaccaccaccagctgcgctcactgactggcctcatccgaaacctgtctcggaacgctaggaacaaggacgagatgtccacgaaggtggtgagccacctgatcgagaagctgccgggcagcgtgggtgagaagtcgcccccagccgaggtgctggtcaacatcatagctgtgctcaacaacctggtggtggccagccccatcgctgcccgagacctgctgtattttgacggactccgaaagctcatcttcatcaagaagaagcgggacagccccgacagtgagaagtcctcccgggcagcatccagcctcctggccaacctgtggcagtacaacaagctccaccgtgacttccgggcgaagggctatcggaaggaggacttcctgggcccataggtgaagccttctggaggagaaggtgacgtggcccagcgtccaagggacagactcagctccaggctgcttggcagcccagcctggaggagaaggctaatgacggaggggcccctcgctggggcccctgtgtgcatctttgagggtcctgggccaccaggaggggcagggtcttatagctggggacttggcttccgcagggcagggggtggggcagggctcaaggctgctctggtgtatggggtggtgacccagtcacattggcagaggtgggggttggctgtggcctggcagtatcttgggatagccagcactgggaataaagatggccatgaacagtcaaaaaaaaaaaaaaaaaaaaaaaaaaaaaaaaaaaaa

SEQ ID NO: 98 - DNA, 1442 bp, Homo sapiens
agcagaggagacccaggggtcccagagctgggctggcgggaggcgtaatccggcggggtgagggttgatcgaagagccccgcgcgcagctgccgctcacagccccttcccgagtgcagagcgggcagagaagtccactgcttttaaggccctgcactgaaaatgcaagctcaggcgccggtggtcgttgtgacccaacctggagtcggtcccggtccggccccccagaactccaactggcagacaggcatgtgtgactgtttcagcgactgcggagtctgtctctgtggcacattttgtttcccgtgccttgggtgtcaagttgcagctgatatgaatgaatgctgtctgtgtggaacaagcgtcgcaatgaggactctctacaggacccgatatggcatccctggatctatttgtgatgactatatggcaactctttgctgtcctcattgtactctttgccaaatcaagagagatatcaacagaaggagagccatgcgtactttctaaaaactgatggtgaaaagctcttaccgaagcaacaaaattcagcagacacctcttcagcttgagttcttcaccatcttttgcaactgaaatatgatggatatgcttaagtacaactgatggcatgaaaaaaatcaaatttttgatttattataaatgaatgttgtccctgaacttagctaaatggtgcaacttagtttctccttgctttcatattatcgaattcgaatttcctggcttataaactttttaaattacatttgaaatataaaccaaatgaaatattttactgataagattcttcatgcttctttgctctccttaaaatgtctttttcactagttagttccaagggtcagtctcataattttgttcttatactttgatttcctttttctttttttttttttttaatagagttgggggatctttctttctttttttttttttttttttgagatagagtctcgctctgttgcccaggctggagtgcagtggcgtgatctcagctcactgcaacctccacctcctggatacaagcgattctgctgcctcagtctcccgagtagctgggattacaggttcccgccaccatgcccagctaatttttgtatttttagtagagacggggtttcaccatcttggtcaggctggtctcgaactcctgacctcgtgatccacctgcctcggcatcacaaaatgctgggattacaggcatgagccaccgcgtccagcctagagttgggggtctttctatgttgcccaggctggtcttgaactccgggcctctagcaagcctctcatctcagcctcccaaggtgctggaattacaggtgtgagccactgcaccatactttggtttcttagcaggagattttggttcacagtaacccagctctctttcatctaagaactttagatgagaaaaaaaaaaaa

SEQ ID NO: 99 - DNA, 3514 bp, Homo sapiens
gcaggccctgagccccggccccgcctcggccggccccgcctcggccggggcgtgggctccggctgcagctccggtctgctctcttggctccggaacccccgcgggcgctggctccgtctgccagggatgacggcgacccctgagagcctcttccccactggggacgaactggactccagccagctccagatggagtccgatgaggtggacaccctgaaggagggagaggacccagccgaccggatgcacccgtttctggccatctatgagcttcagtctctgaaagtgcaccccttggtgttcgcacctggggtccctgtcacagcccaggtggtgggcaccgaaagatataccagcggatccaaggtgggaacctgcactctgtattctgtccgcttgactcacggcgacttttcctggacaaccaagaagaaataccgtcattttcaggagctgcatcgggacctcctgagacacaaagtcttgatgagtctgctccctctggctcgatttgccgttgcctattctccagcccgagatgcaggcaacagagagatgccctctctaccccgggcaggtcctgagggctccaccagacatgcagccagcaaacagaaatacctggagaattacctcaaccgtctcttgaccatgtctttctatcgcaactaccatgccatgacagagttcctggaagtcagtcagctgtcctttatcccggacttgggccgcaaaggactggaggggatgatccggaagcgctcaggtggccaccgtgttcctggcctcacctgctgtggccgagaccaagtttgttatcgctggtccaagaggtggctggtggtgaaggactccttcctgctgtacatgtgcctcgagacaggtgccatctcatttgttcagctctttgaccctggctttgaggtgcaagtggggaaaaggagcacggaggcacggcacggcgtgcggatcgatacctcccacaggtccttgattctcaagtgcagcagctaccggcaggcacggtggtgggcccaagagatcactgagctggcacagggcccaggcagagacttcctacagctgcaccggcatgacagctacgccccaccccggcctgggaccttggcccggtggtttgtgaatggggcaggttactttgctgctgtggcagatgccatccttcgagctcaagaggagattttcatcacagactggtggttgagtcctgaggtttacctgaagcgtccggcccattcagatgactggagactggacattatgctcaagaggaaggcggaggagggtgtccgtgtgtctattctgctgtttaaagaagtggaattggccttgggcatcaacagtggctatagcaagagggcgctgatgctgctgcaccccaacataaaggtgatgcgtcacccagaccaagtgacgttgtgggcccatcatgagaagctcctggtggtggaccaagtggtagcattcctggggggactggaccttgcctatggccgctgggatgacctgcactaccgactgactgaccttggagactcctctgaatcagctgcctcccagcctcccaccccgcgcccagactcaccagccaccccagacctctctcacaaccaattcttctggctgggcaaggactacagcaatcttatcaccaaggactgggtgcagctggaccggcctttcgaagatttcattgacagggagacgacccctcggatgccatggcgggacgttggggtggtcgtccatggcctaccggcccgggaccttgcccggcacttcatccagcgctggaacttcaccaagaccaccaaggccaagtacaagactcccacatacccctacctgcttcccaagtctaccagcacggccaatcagctccccttcacacttccaggagggcagtgcaccaccgtacaggtcttgcgatcagtggaccgctggtcagcagggactctggagaactccatcctcaatgcctacctgcacaccatcagggagagccagcacttcctctacattgagaatcagttcttcattagctgctcagatgggcggacggttctgaacaaggtgggcgatgagattgtggacagaatcctgaaggcccacaaacaggggtggtgttaccgagtctacgtgcttttgcccttactccctggcttcgagggtgacatctccacgggcggtggcaactccatccaggccattctgcactttacttacaggaccctgtgtcgtggggagtattcaatcctgcatcgccttaaagcagccatggggacagcatggcgggactatatttccatctgcgggcttcgtacacacggagagctgggcgggcaccccgtctcggagctcatctacatccacagcaaggtgctcatcgcagatgaccggacagtcatcattggttctgcaaacatcaatgaccggagcttgctggggaagcgggacagtgagctggccgtgctgatcgaggacacagagacggaaccatccctcatgaatggggcagagtatcaggcgggcaggtttgccttgagtctgcggaagcactgcttcggtgtgattcttggagcaaatacccggccagacttggatctccgagaccccatctgtgatgacttcttccagttgtggcaagacatggctgagagcaacgccaatatctatgagcagatcttccgctgcctgccatccaatgccacgcgttccctgcggactctccgggagtacgtggccgtggagcccttggccacggtcagtccccccttggctcggtctgagctcacccaggtccagggccacctggtccacttccccctcaagttcctagaggatgagtctttgctgcccccgctgggtagcaaggagggcatgatccccctagaagtgtggacatagttgaggcccccgtcagggagaggtcaccagctgctgtgccccaccacgtctggctccctgccccttaaccccaaggactgagggcagtgccctttgagatctggggaggcaggcattcctgaagggaactagaggtgttacagaggacccttacgtgagaaatagctgaaaagggcactcccaaccctgggctggggaggaggagagagtcccagagctcatcccccctgctgcccagtgcaaaccacttctccatgctgcaaaggagaagcacagctcctgccagggtgagcagggtcaagcctcttattccaggagaagggggctctgccccaggccctactacccattgttcccttcctcttcctgcccttgaaccccctccctgtcccagggccctcccagcccattgctgccaaggtggagggaaggataaagccacttctggcttcagcccccaccaggggaaggaaggagggcacattaactccctccaccagcctgctgacagacactaactttgtatccgttcaataagcatttcataaataaaggtgtagaaaaggttaaaaaaaaaaaaaaaaaa

SEQ ID NO: 100 - DNA, 1861 bp, Homo sapiens
aataaactggaaagacgcctggtctggcttcagttacagggagcaccaccagggaacatctcggggagcctggttggaagctgcaggcttagtctgtcggctgcgggtctctgactgccctgtggggagggtcttgccttaacatcccttgcatttggctgcaaagaaatctgcttggaagaaggggttacgctgtttggccgggcagaaactccgctgagcagaacttgccgccagaatgctcctcctgttgctgagtatcatcgtcctccacgtcgcggtgctggtgctgctgttcgtctccacgatcgtcagccaatggatcgtgggcaatggacacgcaactgatctctggcagaactgtagcacctcttcctcaggaaatgtccaccactgtttctcatcatcaccaaacgaatggctgcagtctgtccaggccaccatgatcctgtcgatcatcttcagcattctgtctctgttcctgttcttctgccaactcttcaccctcaccaaggggggcaggttttacatcactggaatcttccaaattcttgctggtctgtgcgtgatgagtgctgcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaacagaaagcagacaaagaaaaaagagctagcccaaaatcccaaactcaaaccaaaccaaacagaaagcagtggaggtgggggttgctgttgattgaagatgtatataatatctccggtttataaaacctatttataacactttttacatatatgtacatagtattgtttgctttttatgttgaccatcagcctcgtgttgagccttaaagaagtagctaaggaactttacatcctaacagtataatccagctcagtatttttgttttgttttttgtttgtttgttttgttttacccagaaataagataactccatctcgccccttccctttcatctgaaagaagatacctccctcccagtccacctcatttagaaaaccaaagtgtgggtagaaaccccaaatgtccaaaagcccttttctggtgggtgacccagtgcatccaacagaaacagccgctgcccgaacctctgtgtgaagctttacgcgcacacggacaaaatgcccaaactggagcccttgcaaaaacacggcttgtggcattggcatacttgcccttacaggtggagtatcttcgtcacacatctaaatgagaaatcagtgacaacaagtctttgaaatggtgctatggatttaccattccttattatcactaatcatctaaacaactcactggaaatccaattaacaattttacaacataagatagaatggagacctgaataattctgtgtaatataaatggtttataactgcttttgtacctagctaggctgctattattactataatgagtaaatcataaagccttcatcactcccacatttttcttacggtcggagcatcagaacaagcgtctagactccttgggaccgtgagttcctagagcttggctgggtctaggctgttctgtgcctccaaggactgtctggcaatgacttgtattggccaccaactgtagatgtatatatggtgcccttctgatgctaagactccagaccttttgtttttgctttgcattttctgattttataccaactgtgtggactaagatgcattaaaataaacatcagagtaactcact

SEQ ID NO: 101 - DNA, 3749 bp, Homo sapiens
gcggagcgtgtgacgctgcggccgccgcggacctggggattaatgggaaaagttttggcaggagcgggagaattctgcggagcctgcgggacggcggcggtggcgccgtaggcagccgggacagtgttgtacagtgttttgggcatgcacgtgatactcacacagtggcttctgctcaccaacagatgaagacagatgcaccaacgaggctgatgggaaccaccctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacgctatccgttttggtcggatgccggaggctgagaagaggaagctggtggcagggctgactgcaaacgaggggagccagtacaacccacaggtggccgacctgaaggccttctccaagcacatctacaatgcctacctgaaaaacttcaacatgaccaaaaagaaggcccgcagcatcctcaccggcaaagccagccacacggcgccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggagaccggccaggcctcatgaacgttccacgggtggaggctatccaggacaccatcctgcgtgccctcgaattccacctgcaggccaaccaccctgatgcccagtacctcttccccaagctgctgcagaagatggctgacctgcggcaactggtcaccgagcacgcccagatgatgcagcggatcaagaagaccgaaaccgagacctcgctgcaccctctgctccaggagatctacaaggacatgtactaacggcggcacccaggcctccctgcagactccaatggggccagcactggaggggcccacccacatgacttttccattgaccagcccttgagcacccggcctggagcagcagagtcccacgatcgccctcagacacatgacacccacggcctctggctccctgtgccctctctcccgcttcctccagccagctctcttcctgtctttgttgtctccctctttctcagttcctctttcttttctaattcctgttgctctgtttcttcctttctgtaggtttctctcttcccttctcccttgccctccctttctctctccaccccccacgtctgtcctcctttcttattctgtgagatgttttgtattatttcaccagcagcatagaacaggacctctgcttttgcacaccttttccccaggagcagaagagagtggggcctgccctctgccccatcattgcacctgcaggcttaggtcctcacttctgtctcctgtcttcagagcaaaagacttgagccatccaaagaaacactaagctctctgggcctgggttccagggaaggctaagcatggcctggactgactgcagccccctatagtcatggggtccctgctgcaaaggacagtgggcaggaggccccaggctgagagccagatgcctccccaagactgtcattgcccctccgatgctgaggccacccactgacccaactgatcctgctccagcagcacacctcagccccactgacacccagtgtccttccatcttcacactggtttgccaggccaatgttgctgatggccccctgcactggccgctggacggcactctcccagcttggaagtaggcagggttccctccaggtgggcccccacctcactgaagaggagcaagtctcaagagaaggaggggggattggtggttggaggaagcagcacacccaattctgcccctaggactcggggtctgagtcctggggtcaggccagggagagctcggggcaggccttccgccagcactcccactgcccccctgcccagtagcagccgcccacattgtgtcagcatccagggccagggcctggcctcacatccccctgctcctttctctagctggctccacgggagttcaggccccactccccctgaagctgcccctccagcacacacacataagcactgaaatcactttacctgcaggctccatgcacctcccttccctccctgaggcaggtgagaacccagagagaggggcctgcaggtgagcaggcagggctgggccaggtctccggggaggcaggggtcctgcaggtcctggtgggtcagcccagcacctgctcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctgtgtgtgactctgggtggaagtgcccagcccctgcccctacgggcgctgcagcctcccttccatgccccaggatcactctctgctggcaggattcttcccgctccccacctacccagctgatgggggttggggtgcttcctttcaggccaaggctatgaagggacagctgctgggacccacctccccctccccggccacatgccgcgtccctgccccgacccgggtctggtgctgaggatacagctcttctcagtgtctgaacaatctccaaaattgaaatgtatatttttgctaggagccccagcttcctgtgtttttaatataaatagtgtacacagactgacgaaactttaaataaatgggaattaaatatttaagagctgactggaaaa

SEQ ID NO: 102 - DNA, 6256 bp, Homo sapiens
cgcgccgccgctcgctcacctgcgctcccgcccgcccctcggtgcgcgcccggcccgccagccgccgccgcccgcaccccgagcgccaccatgaactcgctcttcaggaagagaaacaaaggcaaatacagccccactgtgcagacccggagcatctctaacaaggagctctcggagctgatcgagcagctgcagaagaatgccgaccaggtggagaagaacatcgtggacacagaggccaagatgcagagtgacctggctcggctgcaggagggtcggcagcctgagcaccgggacgtgaccctgcagaaggtgttggactctgagaagctgctctatgtgctagaggcggatgcggccattgccaagcacatgaagcacccacagggggacatgatcgccgaggatatccgccagctgaaggagcgtgtgaccaacctgcgcgggaaacacaagcagatctacaggctggcggtgaaggaagtggatccacaggtcaactgggcggcactggtggaggagaagctggacaagctgaacaaccagagctttgggactgacctgccgctggtggaccaccaagtggaggagcataacatcttccacaatgaggtcaaggccatcgggccccacctggccaaggacggggacaaggagcagaacagcgaactccgggccaagtaccagaaactgctggcagcatcacaggcccggcagcagcacctgagttcgctgcaggactacatgcagcgctgcaccaatgagctgtactggctggaccagcaggccaagggccgcatgcagtacgactggagtgaccgcaacctcgactaccccagccgccggcgccagtatgagaatttcatcaaccggaacctggaggccaaagaggagagaatcaacaaactgcacagcgagggcgaccagctgctggcggccgagcaccccgggaggaactccattgaggcgcacatggaggctgtgcacgcagactggaaggagtacctgaacctgctcatctgcgaggagagccacctcaagtacatggaggactaccaccagtttcacgaagacgtgaaggacgctcaggagctgctgcgcaaggtggactcggacctgaaccagaagtatggccctgacttcaaggaccggtaccagattgagctgctgctgcgggagctggatgaccaggagaaggtgctggacaagtatgaggacgtggtgcaggggctgcagaagcgaggccagcaggtggtgcccctcaagtaccgccgggagactccgctcaagcccatccccgtggaggcactctgtgactttgagggggagcagggcctgatctcgcggggctacagctacaccctgcagaagaacaacggggagagctgggagctcatggacagcgctgggaacaagctgattgctccggccgtgtgttttgtgatcccccccacagaccctgaggccctggctctggctgacagcctgggcagccagtaccggagcgtgcggcagaaggcagctgggagcaaacgcacgctgcagcagcggtatgaggtgctgaagaccgagaatcccggagatgcctctgacctacaggggcggcagctgctggctggcttggacaaggtggccagcgacctggaccggcaggagaaggccatcacagggatcctgcggccaccactggagcaaggccgggctgtgcaggacagtgccgagcgggccaaggacctcaagaacatcaccaacgagctactgcggattgaacctgagaagacgcggagcacggctgagggcgaagccttcatccaggccctcccaggcagtggcaccacacccctgctgaggacccgggtggaggacaccaaccggaaatacgagcacctcctgcagctgctggacttggcccaggagaaggttgatgtggccaaccgcctggagaagagcctgcagcagagctgggagttgctggccacacacgagaaccatctgaatcaggatgacacagtgcctgagagcagccgtgtcctggacagcaaggggcaggagctggcggccatggcctgtgagttacaggcccagaagtccctcctgggtgaggtggagcagaacttgcaggcggccaagcagtgctcgagcacactggccagccgcttccaggagcactgtccggacctggagcgccaggaggccgaggtgcacaagctgggccagcgtttcaacaacctgcgccagcaggtggaacgcagggcgcagagcctacagagcgccaaggcagcctacgagcacttccaccgcggccatgaccacgtgctgcagttcctagtcagcatccccagttacgagccccaggagacagacagcctcagccagatggagaccaagctgaagaaccagaagaacctgctagatgagatagcaagtagggagcaggaagtacagaagatctgtgccaattcccagcagtaccagcaagctgtaaaggactatgagttagaagcagaaaaactaaggtctcttctcgacttggagaatggaaggagcagccacgtgagcaagagagccaggctccaatctcctgccaccaaagtgaaggaagaggaagcagcacttgccgccaagttcactgaagtttatgccatcaacagacagaggctgcagaatctggagtttgctctgaatctcctcagacagcagccggaagtagaagtgacccatgagaccctgcaaaggaataggccggactctggagtggaggaggcgtggaagatcaggaaggaactggatgaggagactgagcggaggcggcagctggagaacgaggtcaagagcacccaggaagaaatctggaccttgaggaatcaggggcctcaggaatcggtggtgaggaaggaggtgctcaagaaggtgccggatcccgtgctggaggagagcttccagcagctgcagcggacgctggcagaggagcagcacaagaaccagctgctgcaggaggagctggaggcactgcagctgcagctgcgtgccctggagcaggagaccagagacggggggcaggagtacgtggtcaaggaggtcctgcgcatcgagcctgacagggcccaggcggatgaggtcttgcagctgcgggaggagctggaggcactgaggcggcagaagggcgcccgggaggcagaggtgctcctcctgcagcagcgtgtggccgccctggctgaagagaagagccgggcgcaggagaaggtcacagagaaagaggtggtgaaactgcagaatgacccccagctggaggcagagtaccagcagctgcaggaggaccaccagcgccaggaccagctcagggagaagcaggaggaggagctgagcttcctccaggacaagctcaagaggctagagaaggagcgggccatggccgagggcaagatcaccgtcaaggaggtgctcaaggtggagaaggacgcggccaccgagagggaggtcagcgatctcacccgccaatatgaggacgaggctgccaaggctcgcgctagccagagggagaagacggagctgctccgaaagatatgggccttggaggaggagaacgccaaagtggtggtgcaggagaaggtgcgggagatcgtgcggccagaccccaaggcggaaagtgaagtggcgaacctccgcctggagcttgtggagcaggagcgaaagtaccggggtgccgaggagcagctccggagctaccagagtgagctggaggccctcaggaggcgaggcccccaggtggaagtcaaagaggtgactaaggaagtcattaagtacaagactgaccctgagatggagaaggagcttcagcggctcagggaggagatcgtggacaagaccagactgatcgaaaggtgtgatttagagatctaccagctgaaaaaggaaatccaggccctgaaagacaccaaaccccaggtccagaccaaagaggtggtccaggagatcctccaattccaagaagaccctcaaaccaaggaggaggtggcgtctctgagggcaaagctctcagaggagcagaagaaacaagtggatctggagagggaaagagcttcccaggaagagcagatcgcccggaaagaggaggagctctcgcgggtgaaggaaagggtggtgcagcaggaggtggtcaggtatgaggaggagccaggcctgcgggccgaggcgagcgcctttgccgagagcatcgatgtggagctgcggcagattgacaagctgcgggcagagctgcggcggctgcagcgccggcgcaccgagcttgagcggcagctggaggagctagagcgcgagcggcaggcccgcagggaggccgagcgcgaggtacagcggttgcagcagcggctggcagcgctggagcaggaagaagctgaggcccgtgagaaggtaacccatacgcagaaggtggtgctgcagcaggacccgcagcaggcgcgagagcatgccctgctccgactccagctggaagaagagcagcaccggcggcagctcctggagggggagctcgagaccctccggaggaaactggctgcactggagaaggcggaggtcaaggagaaggtggtgctctccgagagtgtccaggtggagaagggcgacaccgagcaagagatccagaggctcaagagcagcctggaggaggagagccgcagcaagcgcgagctggacgtcgaggtgagccggctggaagccaggctttcggagctggaattccataactccaagtcatccaaggaactagactttctgagggaagagaaccacaaattacagctggagaggcaaaacctgcagctggagacccgaaggctccaatcggaaatcaacatggcagcgacggaaacacgagacctgcggaacatgaccgtggcggactctgggaccaaccatgactccagactgtggtccctggagagggaactggatgacctcaagaggctctccaaggacaaagacctcgagatcgacgagctgcagaagcgcctgggctccgtggccgtcaagcgggagcagcgggagaaccacctgcggcgctccatcgtagtcatccaccctgacacaggccgcgagctgtccccggaggaagcccaccgtgccgggctcattgactggaacatgttcgtgaaactcagaagccaggagtgcgactgggaggagatctcagtgaagggtcccaatggggagtcctcagtgatacacgacaggaagtctggcaagaagttctccatcgaagaggccctgcagagtggcaggctgacccctgctcagtatgaccgctatgtcaacaaggatatgtccatccaggagctggcggtcttggtatctgggcagaagtaggcacagctcttgcaactcttcgtaacggcagacgctggccctctcctacgacgcagtgacctccttggtgtcgtcctctccctagccctggtgcaggccaagcattttatacataccctcgctgccaggctgctcagagtcccgcccacatatgagacaggcactggctgaagacaggcaactctcgtcccaaccatcattcaccctgagtgacgtacttcatcctccaatgactggacaactgcgatgccttttcctcccttttcctgtacactcccagcaacaaactcctcatgataactgcacacaatctgaaaaccactgaaggacaagccaaccacagcagccaagcccactccttgcagcatgggtactggtggcacaccagacagtgacactgccccacaaaggcctgggcccgtgggggctgctgcctggcatgacatctctccagatttctggcttaaaaccaactttccatccgagaagcctcctcagtagttactctgctcatgagacagatctgggctccaagccaggaaaggtgaacagaaaccacaagtgtccagccctcggtgctggagtggacgttaattgtcagccaccagactgtcccggcacctacagagaatgtttcacagttctggcatttaaatcctttgatagtggattgtgctgctgttagccttagtttcagtgctttacaagtctcgcttattatctcactggtatttaggtatacaaaacagttgattattcaccacgccaatatctgggtctctgtatctcatgtagaacataagaaaatgggaactaatagggaaatttatttatagcatgaaaataaacctggtggctggagtctgcttgtacggtcaaaaaaaaaaaaaaaaaa

SEQ ID NO: 103 - DNA, 6084 bp, Homo sapiens
gccccaacagcgcgcacgcggctaccgagctggaggaggcggcgggcgcgagacccggaatgcgcagggcccccgcctcgccccccccagcccgggccgcggcccccgccttccccgcagtcgtcccgcactcggtgcccgccccccgaggccggcggctgctcccactcggggccgttgctgcttgtgccgtgagcgccgcccagccattgtccccgtcgctccgtcagccgcgccggaccgcgcaccaggaggcgagagcgcgcatggggagcctctgttgatgccgccgccgcgccgccctccgaggctgcgtcccgggaagcccggctccccgagcgctccggcctggcccggtgccccggacctgagtgcgtccccatggaggcgcccgggctggcccaggcggccgcggcggagagcgactcccgcaaggtggcggaggagacccccgacggggcgcccgcgctctgccccagccctgaggcgctgtcgccggagccgcctgtgtacagcctgcaggactttgacacgctggccaccgtgggcactgggacgttcgggcgggtgcacctggtgaaggagaagacagccaagcatttcttcgccctcaaggtgatgagcattcccgacgtcatccgcctaaagcaggagcaacacgtacacaatgagaagtctgtcctgaaggaagtcagccacccgttcctcatcaggctgttctggacgtggcatgacgagcgcttcctctacatgctcatggagtacgtgccgggcggcgagctcttcagctacctgcgcaaccgggggcgcttctccagcaccacggggctcttctactctgcagagatcatctgtgccatcgagtacctgcactccaaagagatcgtctacagggacttgaagccagagaacatcctgctggatagggatggccacattaagctcacggactttgggttcgccaagaagctggtagacaggacttggaccctctgtggaacacccgagtacctagcccccgaagtcattcagagcaagggccacggaagggccgtggactggtgggccctcggcatcctgatattcgagatgctttcggggtttcctccgttttttgatgacaacccgtttggcatttatcagaaaattcttgcaggcaaaatagatttccccagacatttggatttccatgtaaaagacctcattaagaaactgctcgtggttgacagaacaaggcgattaggaaacatgaagaacggggcgaatgatgtgaagcatcatcggtggttccgctccgtggactgggaagctgttccgcagagaaaactgaagcctcccatcgtgcccaagatagctggtgacggcgacacttccaacttcgaaacttaccctgagaatgactgggacacagccgcgcccgtgccgcagaaggatttagaaatcttcaagaatttctgaggacaggagctcacatctggaagaaacaggaagattggaatctgcctggaacaaagaactgcacctaagcagaccagaagcaaaatgtcttcttcacggcataaggacatctccacttttctctgtacctgtgtgtatagaaatagattagagcacagttgaaattcatggaactggcattatttaagcaactggaattccacactgtaggaaggttttgaaaattgtttggttgtagattttatcttatcctttagtgttgtgttcctactgtgatgtcttggtttttgtcatagacttaagtttataagtttgaactggacttgttcgattataaccacaaattgtgtgtgtgtgtgtgtgtgtgtgtgtgtgtgtgtgtgtgtgtgtatgcctgtgtgtatatatagaagtcattatggcagatgcacagaaattgtgcagtgatgtaaatgttcatactttacagagcctataatttttatttttcaatttgttttttcaaaaatctcttctcggggacaacatctgaagggtatgttgcatgcattaaaaaaaatcatctcacatgcattttatagttttggggaagaaaatatcatggggaggtctaccttcagtatctttagtgcttcttacctggtaacttgagactttaaaagaagaaacaaagaggggaagatatgggagcgaatttattccaagaatctacaatgacattgaagttgttggaggaatgtactgtatttaaaaaaaccttctgtgacacattcaaaaatttcatctgagctggatgcagtggcttgttcctatagtcccagcactttgggaggctgaggtgggtggattgcttgagcccaggagttggagaccagtctgggaaacgtggtgagacctcatctctacaaaatacaaaaaaattagccgggcatggtggcacgtgagtgtagtctcagctactcaggaggctgagatgagaggatcacttgagcctggggaggtccaggccgcagtgatccgagatcacaccactgcattccagcctgggtgacagagtgagaccctgtccaaaaaaaaaaaaaaaaaaaaagaaggcaatggctttgtgcttttgaagatggattgaagagaacgtccaccttaaggctttaaaagacagtgaagctgggtgcggtggtgcactcctgtaaccctgggactttgggaagctgaggcaggaagattgagcctaggagttcgagaccgacctgggcagcatagcgagaccccatctctatataaaaaaaaagatgttaaaacagtgaaattacagaaacagaacatagccaccctttttcatcagtgaccttttcttcacgtggaggtcaactcagtaggtgagaataattagtaggttcagcagaataaactctttacaattaataactcagtggaaaatgatgttcagatggtgaaatgtggaaatgttttagacaactctattttcagcctgtgcttctcactcaccatcctgttgggattaacagttgagggccatcgctgcctaaacatttagcgtgcggtttcccatcagttttaccgtgaatgtgaaaaggtgaaactggtgctgacttcggcagcaggtatactaaaattggaatgacacagaggagattagcatggccccctgcgcgaggaagatctgcagattcatgcagcattccatatttttttaagaaaaggttacactgtgcaccgacatgtggagctagaaggaaaagcttttaagtctcatgtttgctgactataaaaataaatcatagtaataatattgaacattctactttaaaaattattaataaaaccataaatgaaacacttgagcacactttaaaaagtacataaatccatgagtccatatgcctatttttaggttgtctgttttattatccaggatttcatactcagatgagaattagcatcaggaaagcctgaaatgccttaattgtgaactgatatgcaggaaaatgaaatatgcaagcacattggtgaccttgttctttacagacgtcgtgatcagcctccagccatacagaacaaatgagaaattagaagcgattccaagaacgtgtgatggtgtgaaacccactttggaccatcacacacatttcagcatttgaagtgacacaagctacctggtaactgcccatggcggggtcatagtttaaatggcccaatgtcatgtagaggttaatttaatcaaaatgagctataaacatggagcaatcactgtataattttaaaatagtttacctggccaggcatggtggctcacgcctgtaatcccagcactttgggaggccgaggcaggtggatcacctgaggtcaggagttcgagaccagcctggccaacatggcaaaacccccatctctactaaaatacaaaaattaggtgtggtggcgggcacctgtaatcctggctactcgggaggctgaggcaggagaatcgcttgaacccgggaggcagaggctgcagtaagccgagatcgtgccactgcactccagcctgggccacagagcaagactccgtctcaaaacataaaaataaaaaaaatacaaatagctgacccgggtgggcattccaaaatgtccgcatggacgatcacgaaacaatcacggtgcgaaatgtccgcatggatgatcacgaaacaatcacggtgcagaatgtccgtatggatgatcatgacaaacaatcactgcgcaaaatgtggaggaaaattcattaccataatcacaacatttgtatcagaaaaacattacaaatttactttgcttcatgtaattttacgagttggcaatattttcttaaattggaatactctaagagaataggacatggatatgttacaagaagaagtgtattggggcaagtcttgtttttctgaagggaaatgccaccggcctgctttcataggcattgataaagccaggaaggaaataaagtcacaaccaaatagtatacactgtctctactgaattcttctaattccttcgcaacagaagtctaaatcctgcttagcctaaacatatctatagccagcgatgggcaaattatatttgctgtcagcatgatagaataagaagcagaaaccccccagcagtggggtaagattgcgcgcttcatcccctcaaaatgcagttcagccccactccctctccatgcccatcaaacaactgcacaatcacttgttactgaatttcccattcagcgttttgtttctttctgtccatacttaaagaccaaatcatttgtttgctttgaagaaaaagcaaaaacaagaacaaaaacaccaaatcatttgaaatcactgtccattaaaaaaaatcaccagtggaactaaacagttgagtggtttgggatgtgttcgccatttctgtgtttgacctacatggcctctaattctttggaccattgtaactgtgaaactatggcttaatactgttaaagaccccaaggctccactctgtagccaggtgcacctcaggctgcacaaataccccaccagaatgtcacaatcattcattgctccagctactgagtgaacagggtgcaagacagcactggcttgggttgtatttttgcagccagttaactttgcatcaggtctacacagtccttgcagcctttgatttctccagttgtagagatttgaaatggggtgcccgggttcctctcgtttttccttcaatctacctagcatgcattttacacacattggaggagtcgtatgcactgtttttctgttgctgatggaggcaagcaggccttctaattagtctaacttaaacggatgggattcacttaacaaaagcaagaagaaaagcacacgaacaggtgtcttaatgcatttggatagtttctttgcggggtgtgtgtgtgtgtgtgtgtgtgtgtgtgtgtgtgtgtgtgtgtgtgtcttggtgaaggtgaggggctgtattttcaccaagccttttcataatcaagtttgctttgcaaaccttatggccttgcaccccgcagaacagtcccttcctaatagcagggatgctctgtcatggttttctgtaaattatcgtgtgttgggaagttctgttgaggcttagtttgatcttccatggtggacacgtctgttctgtatgtaaaaggcattacaattgtgttttagcagatgagacttgaagcctttccacagtccttgtgctctgagatggctgttgagctctgctcaactgtcgtagctgaattctttctttgcgctgaacactgggcagcctcaccatgttgccaacgtgcttctggggcccctgtcactgccgccggatgccgcgcacacaggcagagtgccttggcaggtttgtgcaccccttggcgagccagaactgggaaccccgcggggtgaccccttctcatggggggtcggggaggggagtgcctatttttaatcctgtctgtttgttgcacaatggaaatcactgtgatttgtacatatgccctaggaaaattttactgctgtctaatttatgtaataatactgttgattccaggtttgtttaataaaactttgtatcttttcagaagtctgagtttcatctgcttctgtctcc

SEQ ID NO: 104 - DNA, 1485 bp, Homo sapiens
ctgtctcaaaaaattaaaaaaaataataataataataatgaatgaagctggacggacttcgcgtgcaccgcggtcagctcggggtctgctggggggtctgggtcagctcagggtccaggaaccgaggccaacggcaccccgtgctgcgctggggtgaggggtctgccctggggtctcggggttcagggctaggtcacggaggagtcggctctgggcgcttccttcctgaggagaggagctgggcaggccgggccgacgggttgggccgcatagccgggcctgtgctcatctccagcataaaactccacttcatggagcctgcacctcgctcgtgctccaacgcttctgccaccgccgaccacggccctgcgccccagccaggcctgaggacatgaggcggccggcggcggtgccgctcctgctgctgctgtgttttgggtctcagagggccaaggcagcaacagcctgtggtcgccccaggatgctgaaccgaatggtgggcgggcaggacacgcaggagggcgagtggccctggcaagtcagcatccagcgcaacggaagccacttctgcgggggcagcctcatcgcggagcagtgggtcctgacggctgcgcactgcttccgcaacacctctgagacgtccctgtaccaggtcctgctgggggcaaggcagctagtgcagccgggaccacacgctatgtatgcccgggtgaggcaggtggagagcaaccccctgtaccagggcacggcctccagcgctgacgtggccctggtggagctggaggcaccagtgcccttcaccaattacatcctccccgtgtgcctgcctgacccctcggtgatctttgagacgggcatgaactgctgggtcactggctggggcagccccagtgaggaagacctcctgcccgaaccgcggatcctgcagaaactcgctgtgcccatcatcgacacacccaagtgcaacctgctctacagcaaagacaccgagtttggctaccaacccaaaaccatcaagaatgacatgctgtgcgccggcttcgaggagggcaagaaggatgcctgcaagggcgactcgggcggccccctggtgtgcctcgtgggtcagtcgtggctgcaggcgggggtgatcagctggggtgagggctgtgcccgccagaaccgcccaggtgtctacatccgtgtcaccgcccaccacaactggatccatcggatcatccccaaactgcagttccagccagcgaggttgggcggccagaagtgagacccccggggccaggagccccttgagcagagctctgcacccagcctgcccgcccacaccatcctgctggtcctcccagcgctgctgttgcacctgtgagccccaccagactcatttgtaaatagcgctccttcctcccctctcaaatacccttattttatttatgtttctcccaataaaaacccagcctgtgtgccagctgaaaaaaaaaaaaaaaaaaa

SEQ ID NO: 105 - DNA, 2144 bp, Homo sapiens
ccacagaagctgctcagggactatccatggcctccccgtggccaacttgagtctgctctgcagctttaggcccgacttggaaggcccatgggctgcagatgaggaaactgaggtccagacagccgaagagtggtagtgtccaggacacacaactgggccggcggcggcggctgccccgagggacgcggccctaggcggtggcgatggggaccgcccggatcgcacccggcctggcgctcctgctctgctgccccgtgctcagctccgcgtacgcgctggtggatgcagatgacgtcatgactaaagaggaacagatcttcctgctgcaccgtgctcaggcccagtgcgaaaaacggctcaaggaggtcctgcagaggccagccagcataatggaatcagacaagggatggacatctgcgtccacatcagggaagcccaggaaagataaggcatctgggaagctctaccctgagtctgaggaggacaaggaggcacccactggcagcaggtaccgagggcgcccctgtctgccggaatgggaccacatcctgtgctggccgctgggggcaccaggtgaggtggtggctgtgccctgtccggactacatttatgacttcaatcacaaaggccatgcctaccgacgctgtgaccgcaatggcagctgggagctggtgcctgggcacaacaggacgtgggccaactacagcgagtgtgtcaaatttctcaccaatgagactcgtgaacgggaggtgtttgaccgcctgggcatgatttacaccgtgggctactccgtgtccctggcgtccctcaccgtagctgtgctcatcctggcctactttaggcggctgcactgcacgcgcaactacatccacatgcacctgttcctgtccttcatgctgcgcgccgtgagcatcttcgtcaaggacgctgtgctctactctggcgccacgcttgatgaggctgagcgcctcaccgaggaggagctgcgcgccatcgcccaggcgcccccgccgcctgccaccgccgctgccggctacgcgggctgcagggtggctgtgaccttcttcctttacttcctggccaccaactactactggattctggtggaggggctgtacctgcacagcctcatcttcatggccttcttctcagagaagaagtacctgtggggcttcacagtcttcggctggggtctgcccgctgtcttcgtggctgtgtgggtcagtgtcagagctaccctggccaacaccgggtgctgggacttgagctccgggaacaaaaagtggatcatccaggtgcccatcctggcctccattgtgctcaacttcatcctcttcatcaatatcgtccgggtgctcgccaccaagctgcgggagaccaacgccggccggtgtgacacacggcagcagtaccggaagctgctcaaatccacgctggtgctcatgcccctctttggcgtccactacattgtcttcatggccacaccatacaccgaggtctcagggacgctctggcaagtccagatgcactatgagatgctcttcaactccttccagggattttttgtcgcaatcatatactgtttctgcaatggcgaggtacaagctgagatcaagaaatcttggagccgctggacactggcactggacttcaagcgaaaggcacgcagcgggagcagcagctatagctacggccccatggtgtcccacacaagtgtgaccaatgtcggcccccgtgtgggactcggcctgcccctcagcccccgcctactgcccactgccaccaccaacggccaccctcagctgcctggccatgccaagccagggaccccagccctggagaccctcgagaccacaccacctgccatggctgctcccaaggacgatgggttcctcaacggctcctgctcaggcctggacgaggaggcctctgggcctgagcggccacctgccctgctacaggaagagtgggagacagtcatgtgaccaggcgctgggggctggacctgctgacatagtggatggacagatggaccaaaagatgggtggttgaatgatttcccactcagggctggggccaagaggaaaaacagggaaaaaaagaaaaaaaaaagaaaaaggaaaaggaaaaaaaaaaaaaaaaaa

SEQ ID NO: 106 - DNA, 3651 bp, Homo sapiens
aatcagcgatcagactccggagtttggcccgggagctggggagctcaccgatcccccgcccagcagttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagccatggaggaccccacgctctatattgtcgagcggccgcttcccgggtaccccgacgccgaggccccggagccttcctccgctggggctcaggcagcggaggagccgtcgggggccggctcagaagagctgatcaagtcggaccaggtgaacggcgtgctggtgctgagcctcctggacaaaatcatcggggccgtagaccagatccagctgactcaagcacagctggaggagcggcaggcggagatggagggcgcagtgcagagcatccagggcgagctgagcaagctgggcaaggcgcacgccaccacgagcaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccaggatgaagtgaagctgccggccaaactgagcatcagcaaatcgctgaaagagtcggaggcgctgccagagaaggagggcgaggagctgggcgagggcgagcggcccgaggaggacgcagcggcgctggagctttcgtcggacgaggcggtggaggttgaggaggttattgaggagtcccgcgcagagcgtatcaagcgcagcggcctgcggcgcgtggacgacttcaagaaggccttctccaaggagaagatggagaagaccaaggtgcgtacccgcgagaacctggagaagacgcgcctcaagaccaaggaaaacctggagaagacgcggcacaccctggagaagcgcatgaacaagctgggcacgcgcctggtgcccgccgagcggcgcgagaaactgaagacgtcgcgggacaagttgcgcaaatccttcacgcccgaccacgtggtgtacgcgcgctccaagaccgcggtctacaaggtgccacccttcaccttccacgtcaagaagatccgcgagggccaggtggaagtgctcaaggccaccgagatggtggaggtgggcgccgacgacgacgagggcggcgcggagcgcggggaggccggcgacctgcggcgcgggagcagccccgacgtgcacgcgctgctggagatcaccgaggagtcggacgccgtgctggtggacaagagcgacagcgactgagccgcccccgctgccacccaccccattcctcgctccttccgaacttcctctttcgcattctctctcggctcgagctggctgagatttttctaaattgaaaacacgcccccctccccacacctccaggaactccactcccagtcttagagctgttaggacccgatggggaggcagcccccgcagtggacaacccccgcttggacacagtccgagtggaatgggaagggaatggtcaatccctgtcctggttgtccaagtcgggatctcagaggaaattgcagtgattccacggttaggcccccctgggggggctgccttcccctcagcctctccccacaccacccacccagctgctgtcattccgctcactgagctcttcttcattctcaccctgatccctgggggactcaaagccaaaactgcccaaagaggaaagattgaatcctaaaggggatccctgcccccatgggaggccccctactagaaggacgtgaaagcagcttttgggggaaactgaggcagtggggaagacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgtacacaggagcgcatggccatggctttggaaaggagaatggaaaaatagaagaaggtcggccgggcttggtggcttatgcctgtaaccccagcactttgggaggccgaggtgggcggatcacctgaagtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccatctcaacagaaggaaaaaaaaggaaaataggagaaggtggaaatgggtgaagagagaagtcccctcactagctgcatgagaaatctatcttactgtggttctccatgggcagcaggaccatttttcagaatcaagagggaggacagtgtgagaaggcgatgatccaaagaagacagagaggtcagccccacccgatccctcaaatgggctcttggaggcacccccaggggcagcccatttctcaaagtccagaaaattagggtcccagaagggggcagcagcaggctgggagttaggagggagagcagggtgccggccctgccaccaagttgagagctggaggggaggtggggagagaacatcacagagcagccagccctggttcactcctggcagtttcttctcaagctccttccctaggagcatggtggcacgtgcctgtggtctcagctacttgggaggctgaggcgggaggatcgccagagcccaggagtttgaggctgcagtgagctatgagggtgcctctgtgctccatcctaggcaacagagtgatacgctgtttaaaaaggaaaaaatccttccctagagctagtatcctaaagctgcagagctagcccagacctcattggtttccttgtccttggggtgcttttcctgaatctttgcgggtgaagggagtgttgctcccagtccagaggcctgattctgtttggactgggttctcaagacacgaccaggttctcaagacacgagtccccttgttcctccccattaaagggggtttgtcagaagcaagaacagcccctctccccagtcacagcctgaagggaggccccgagagcttcctccttccccccacctgctccttaccttctctgccctgctttttagaactgcagttcattgttttaagggattgggggagggagcctggggacacaaaccttttatacaatacaaagctttgctttttttttttttttcttccttttccctttctcggttctcttctctcctctgaatggctgaagacccctctgccgagggaggttggggattgtgggacaaggtcccttggtgctgatggcctgaaggggcctgagctgtgggcagatgcagttttctgtgggcttggggaacctctcacgttgctgtgtcctggtgagcagcccgaccaataaacctgcttttctaaaaggaaaaaaaaaaaaaaaaaa

SEQ ID NO: 107 - DNA, 1138 bp, Homo sapiens
ctcttcctgttctcagcttccgtcctctctgcttccttacagcacccccacctgccagagctgatcctccctaggccctgcctaaccttgagttggcccccaatccctctggctgcagaagtccccttacccccaatgagaggaggggcaggaccagatcttttgagagctgagggttgagggcattgagccaacacacagatttgtcgcctctgtccccgaagacacctgcaccctccatgcggagccaagatggggaatggaactgaggaagattataactttgtcttcaaggtggtgctgatcggcgaatcaggtgtggggaagaccaatctactctcccgattcacgcgcaatgagttcagccacgacagccgcaccaccatcggggttgagttctccacccgcactgtgatgttgggcaccgctgctgtcaaggctcagatctgggacacagctggcctggagcggtaccgagccatcacctcggcgtactatcgtggtgcagtgggggccctcctggtgtttgacctaaccaagcaccagacctatgctgtggtggagcgatggctgaaggagctctatgaccatgctgaagccacgatcgtcgtcatgctcgtgggtaacaaaagtgacctcagccaggcccgggaagtgcccactgaggaggcccgaatgttcgctgaaaacaatggactgctcttcctggagacctcagccctggactctaccaatgttgagctagcctttgagactgtcctgaaagaaatctttgcgaaggtgtccaagcagagacagaacagcatccggaccaatgccatcactctgggcagtgcccaggctggacaggagcctggccctggggagaagagggcctgttgcatcagcctctgaccttggccagcaccacctgcccccactggctttttggtgccccttgtccccacttcagccccaggacctttccttgccctttggttccagatatcagactgttccctgttcacagcaccctcagggtcttaaggtcttcatgccctatcacaaatacctcttttatctgtccacccctcacagactaggaccctcaaataaagctgttttatatcaatgcctggtcaaaaaaaaaaaaaaaaaa

SEQ ID NO: 108 - DNA, 5561 bp, Homo sapiens
agggggccgactggcgcggctctggagagcgctcctccgccccgcgcgccgtccctgcgccccgctccgcccgcgcctctctcccagcgccgcgcctcgggcgtaaagagcgcgcccctcgcaccgcagccagtgccgaccgcagcagcccagccccagccttcctccgcctccgcctctctctcctcctcctcctccgccgccggacacgcagccgcaggccgggaccgggacgcagctggggagtcagggacgcgcgcagccagcccttccccctccggctcccgcaccgccggccgcctcccctcgccctcctactctcccctccctgctccttcgctttttcctcctcctcctctcccggccccggctgccagcaccatgtccgcagggggagattttgggaatccactgagaaaattcaagttggtgttcttgggggagcagagcgtcgggaagacgtctctgattacgaggttcatgtacgacagcttcgacaacacataccaggcaaccattgggattgacttcttgtcaaaaaccatgtacttggaggaccgcacggtgcgactgcagctctgggacacagctggtcaggagaggttccgcagcctgatccccagctacatccgggactccacggtggctgtggtggtgtacgacatcacaaatctcaactccttccaacagacctctaagtggatcgacgacgtcaggacagagaggggcagtgatgttatcatcatgctggtgggcaacaagacggacctggctgataagaggcagataaccatcgaggagggggagcagcgcgccaaagaactgagcgtcatgttcattgagaccagtgcgaagactggctacaacgtgaagcagctttttcgacgtgtggcgtcggctctacccggaatggagaatgtccaggagaaaagcaaagaagggatgatcgacatcaagctggacaaaccccaggagcccccggccagcgagggcggctgctcctgctaatgcagagccgacctgtggcttcccatgacactccttgcttgttgtgttgcttcctattggctagcttcctaaggggggagggaaccgagttatcaagatgggaggatttttcttttctctctgtctttaggagtagggtgggatggggagggaggctgggcatcagggatcacatcactcttaacggctgttacttaaacaactattttttggtttggttgtaatatattgtactttattaagattgccaaaaactgttaaaatttaaaaaaaatttaaatcatgtgtatacaattttttgccagataaaaatgtagtcatttttatttgaaagatgtgctttttgtttttgtatatttgtaaacttatagagaaccttttccacacacctcctccttcctgttctctttgaaccattcatcacctctgccttcctcctatccccagcccaataaattaaaacaattaactgagcaaattaattaggcttcagtctggggccatctggccccactctctaggccctactccagttaaatcaaacattggttgaacacatcagcctctgaaaaggtagctctgactcttgtctttccatggccagagtgggtcgtcaacctcgtgtggagctgagaccaaggtctgtgggctctaggcagcccggcagcagcccccagaggaactgctcccacctctccttctctttccctgaaaagccttgaagggggttgagggtacaggcaaccttgtgttctctgtgccctcagggactggcagagcaagaggccatcagaaggacgaggtgctgttggcaattgcagctgcgtggtgcgtggtttatagactggggtgccatgtgtacttctgaaaatattttaaccagcccacccagcagtcagtacacatgcctgggccaagtctaagaaactcagtgtgtgatgttgggcagtgtgccatcctgaagccttcctcctggatgtcagggaagctggaccacctggagttgatcctctgtgatggggaggcgggggggggggggggtgttgtctgcagaaccaccaccttgaaagatccatgttcttagagcctcagctgctaatattgttgagtgctttctggaaaagctgatttgttgctatgttttcaccccagtggcatggcgcagttgaagtctttgtggacatatctttgtggctactgtggctgcgctgtggtcacctgaggatgtggttcaggtggggtctccagaaggctgcttgcccccagagagccatctcttccatttttgattcattcctgagaatggcttagtcctgagaatctgcaaagtctctgaagagaactctctcttcccactaagtgatataacctacttggccagcattccaaatagactcagactcactgccctgagcctgcacagagccaggtgcaatgggcagtgagtctggccaaaatgtaaaccccaccctccctgctgtcattggctctccctccaggctgctgctgggcatgtcatagatgggatgaatgaccatctggggtatggtgggctgaactccacaaggtcgttggaatgaattttgaaacttctcagaaattaatctgaaatggcaggcagtaagtgcagcagaatctggcaggactgatatttgtgcagtgggcctgccacacaccctctgcctaggaggctgtatgccagagctcatctctagcaaggaatttatcttcaggtgaagaagagaggaagcaggatcccactgagcacctcttgcagaaggcaaggaccaatgtttgaacgtgtttcagatgtcatgtgtttagtttttatatgtgtgtacataattatatatagagatagacttgtgtatacaccttccacaaacacatcctcacggagatacatgtgctcaatgtatattcttgtttctcctgctctcaagttggaacttgcattgtgataagttttggaaattcaaaagtactgcaacgtgttgaaataagaaatacttaatattgtcaaataacttgtgattgtcttgccatcaataaaataatgcatagttgtgttaaactacaggcaaacatagcccacgggaatatctccaccatttctctatgtactttatatgcacgggtgtgcatgcctgtgtgggccagtgtccccccaccatgggcacacccccaagtggtgcttgttggaagagtgcttacttacctcgagagaatttacaggagtccacatgacagtgtcctgcctggttggcagcgggggccatcacctgtggcctctgagaccgccccatttacaggaatctgcactgggtctcagtgaatgaacgtatggtagatttttattttcttggcactaaagattagcttttttaaaaaaacatcccataaaacagtagaaactcagttcccttctcaggggcacacacatccaaggcaccgtggactgtgtttccatcctggcctagaggagcagtaaaagatagcatttggtttgacatggccttagtgagtcctgcctttcctagcatgcacacaacatcctctctttgagtttgggttctccccagccccttggcctctgaggctgagggtggcttcctcccatcctcccatctcagtggttccatggcgctcccttcggcacgtgcggtttccgcccctcccttcctggggtgtggaaaggcagccagacctctttttcagaagttgttggttccctgatttttgtcttgagcaggcaccatccctgtccccttgcttgcaggtagaattggcacagagttaaggttccataataaactgttaggtgctcttgaagaagatgtcatggcattgcctcagcaccccagcaagagcattgcatctttgctgaatccagatgggttagcagagggcaaattggaggattcctttgaggaaatgttctcaattgagcaattcagtccctctccccaaagactagacgtgacctggcagattagcaggatcctcttggccttcttttttggggatggtgggagtgaagggggtgaatcttaaaagcttatcaacaaagctcctgttctgcaggcatcaggaaagttgagtgtaagatggaaaaagcaaacagcctatttacaagtggaaacacattggttctgatcactcctaacttgctgggtgatcatacatacatcaacatgaaggtgtgacatcagaatcatgagcaccatggctgcagttgtgtgatccaaggctagttggcttggtagctgttggcagcagtttcccttggtcagaggcctccttgctatctatcgctgctctcttcttgtcatccttaaacattcagtcatgttcccaggtctgaggggagcaatggccagaccagtttcagtatctctggcaacagaaacaaggattgaaatggtggtagttaagagtgcagacacatctggggtgcaacgtctgcatcatcctggtggctagccagtgcggggaggccctgccctgggataccagttgtgacaataaagggatggccctcctggcttcagcatcctgcaggtagagcagcctcattccttcacaagatggaaggcaggtgaggatgtcaggatgagatgggaccaggtagccgaggacagtgaggcatgtctgagccacttgaggggcagctgaacagaaggatgtctgtgtgcatcaaccgagcagattgtgcgcacactcgtttccgaactgcctctccccaaagaatgtgaggcattgtcaccttgttacagctatgtgaagcagagctgtcacaacttttcctgtctacaggcaggaaaaccaggatggagaagggcaacttgcttattaagatcacccagcaagttaggagtgatcagaaccagtgaagtttccatttttcatccattgctgccctgtgtgtgaacaaatgtgactccatatttattacacagcaaggactgctgtgtgtgggtgtgttcctcagaccatctctactctttttggttaggacactaggttcttcccagcatatgagtgagaatattggtggtattttgggctcctctactgcacaagggccagtccccaagtctactctgattgattgtcatgggcacccacacagatcaggacaccctttgaatttttgtttgacatgaactatttaggtgttccaaaaccttgggatctcaatgtgcaaactccttggactccagacccctgtctggttggcactcccagcagtgtgtggtttcatcaggaaatccttgcagcaggggtttagatggttccttcaggaggtgggaagcctccatagcattgaaggccagcctgcatctcgcggtgtgtgtccacttctcccctcactttcccctcacccatccctttaaagtgattggctgtgaggagcacagagggtggcaattccatctgttatgggctcagaagacatagccgccatgttgatttcacattaaactgtgtaaaatgtggaaaagactcagcatgttggtcaaacaataaactgtcctaattctcaaaacaaa

SEQ ID NO: 109 - DNA, 1882 bp, Homo sapiens
tttttgtttatttttgttttgttttgttttgtttggtatagaagtgttggaacgtacacctctttcttaaaccatcctgacaaagggaaagggaaaaatacatttcccgtgaggcgttgtgactagaacagctggaggtggacggcagagtgccgcgacgactgccaggagttgtagttctccccggccgcgtcactgcggtgtcgcccacccttcttccccgggcaggccgcggtttcctttgtggacgtggcgaggagtgcccgcggcaccccgtgcactcattggccccgccccgtgagacgctcgtgcgagctcattgggcggggggcggggctctgcgctgccagaggcggggcctgactggagagcggccgaattgggcacatttgcgggaacgcagagcggagcgtggagagcggagcgaagctggataacaggggaccgatgatgtggcgaccatcagttctgctgcttctgttgctactgaggcacggggcccaggggaagccatccccagacgcaggccctcatggccaggggagggtgcaccaggcggcccccctgagcgacgctccccatgatgacgcccacgggaacttccagtacgaccatgaggctttcctgggacgggaagtggccaaggaattcgaccaactcaccccagaggaaagccaggcccgtctggggcggatcgtggaccgcatggaccgcgcgggggacggcgacggctgggtgtcgctggccgagcttcgcgcgtggatcgcgcacacgcagcagcggcacatacgggactcggtgagcgcggcctgggacacgtacgacacggaccgcgacgggcgtgtgggttgggaggagctgcgcaacgccacctatggccactacgcgcccggtgaagaatttcatgacgtggaggatgcagagacctacaaaaagatgctggctcgggacgagcggcgtttccgggtggccgaccaggatggggactcgatggccactcgagaggagctgacagccttcctgcaccccgaggagttccctcacatgcgggacatcgtgattgctgaaaccctggaggacctggacagaaacaaagatggctatgtccaggtggaggagtacatcgcggatctgtactcagccgagcctggggaggaggagccggcgtgggtgcagacggagaggcagcagttccgggacttccgggatctgaacaaggatgggcacctggatgggagtgaggtgggccactgggtgctgccccctgcccaggaccagcccctggtggaagccaaccacctgctgcacgagagcgacacggacaaggatgggcggctgagcaaagcggaaatcctgggtaattggaacatgtttgtgggcagtcaggccaccaactatggcgaggacctgacccggcaccacgatgagctgtgagcaccgcgcacctgccacagcctcagaggcccgcacaatgaccggaggaggggccgctgtggtctggccccctccctgtccaggccccgcaggaggcagatgcagtcccaggcatcctcctgcccctgggctctcagggaccccctgggtcggcttctgtccctgtcacacccccaaccccagggaggggctgtcatagtcccagaggataagcaatacctatttctgactgagtctcccagcccagacccagggacccttggccccaagctcagctctaagaaccgccccaacccctccagctccaaatctgagcctccaccacatagactgaaactcccctggccccagccctctcctgcctggcctggcctgggacacctcctctctgccaggaggcaataaaagccagcgccgggaaaaaaaaaaaaaaaaaaaaaaaaaaaaa

SEQ ID NO: 110 - DNA, 3033 bp, Homo sapiens
gcgggggcgcgtcggggctggagccggagcgcgccgggcgctgggcgcagcgagcgagagcgcggcggccgcgggctccggcgagggacagacgcaccgatcgccggagggacagacacacgaccacgcggcgccaccgcccacgcctccacccaccggcgcccaagtcctccccgcgccgcctcctctgtatggcacaaactttcctcccgggacggaacacgctgcctcagggagcccgcgaccgcgccttctcctccgccggtcccatacgctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccaggaggctgcaagccagggcctgaaattcgttggtgttatacctcagtaccattcctctgtgaactcggcaggcagcagtgctccggtgtctactgccaacagcaccgaggatgccagagatgcaaaaaacgcacgtggggatcacgcgtcactggagaatgagaaaccggggactggggatgtgtgcagtgctccggctgggagaaaccaaagcccagagcccagctcaggccccagaggggaggtgcccctcgccaagcagcccagctcaccctccggagagggagatggtggagaactttcaccacagggggtgagcaagacactggatggaccggagagcaaccccttggaggtgcatgaagagccactctcagggaaaatggagatcttcacccttttcaacaaaccgaagagccatcagaagtgccggcaatactaccctgtcaccattcctctccatgtctccaagaatggccagacagtgagcggtttggacgccaactggttagagcacatgagcgaccacttccggaaaggaggcatgctggtgaacgcagtcttctaccttggaatagtgaatgattccttacatggcttgacagatggagtattcatctttgaagctgtttccacagaagatagcaaaaccatacagggctatgatgctattgtggttgaacaatggacagtcctggaaggtgtcgaagtgcagacagactacgtgcccctgctgaactcgctggcggcctatggctggcagctcacctgtgtgctaccaactcccgtcgtcaagactaccagcgaggggagtgtatccaccaagcagattgtctttcttcagagaccttgtctacctcagaaaatcaagaagaaggaatcgaagtttcagtggcgattctccagagaagaaatgcacaacaggcagatgaggaaatcaaaaggtaaactcagtgccagagacaaacaacaagcagaagaaaatgagaagaacttagaagaccagtcttccaaagctggagacatgggaaactgtgtttcaggacagcagcaggagggtggagtctccgaggagatgaagggccctgtccaagaggacaagggagaacagctgtcccctggtggcctgctgtgtggggtgggtgtggagggtgaggctgtgcagaatggtcctgccagccacagcagggccctggtggggatttgcactgggcactccaatcctggagaggatgccagggacggggatgctgaggaagtcagagagcttggtacggttgaagaaaactgagtcttgggcaatttgtgctaaaactaggtgagttgccaaacccaaggcatcttaccaacagctggtttgggggctggtttccctggtgttgtgtgttacctaccctttggcttggcttgacctctccttgtgagctcacctgagccctcccagggccaggttcctgacagtgttggtttttgcacatccactggaaaggtgtcattaatgacccagtgttagaatgcaagaggtcaggttattctagccctcatggctgaaggcccagtcctggctccaccactcctccagccagagggtctggaccatccagtgcctgtcctcgccacagggcctccagggagcattcgggtcaaatccatggacaccctgggctacaaaccaaggctgctgttcatcccacatcgtgtggggcagtgtccatcccctgcagctacttggtgacttaacaactccaggagccctgtcagctgccctcctccacctaaaccccttcgactcttctgctttgacaaagaaaatgacattggggaggggaggtgctccgcctcccagcttttctcaaaatagtcctatagatactggtaatctggaaatgaagaagtaattctgtctctgcacctacttttgcagaatgttcaaggaagtattctgtgttagtattaatgccaaaaagttgtttttaaaggttttgtactcagcacatcatacaaaccacattacttctgtcacttcagggcatcgggactggctggcgcccttgttatgtgctattttaatcagtgtaacattggtcaagttgttacccatgtatgctgtgtttatcatgtgtatatcgtccagaaagtattaaggctttaggtagatgcaactggcgaaccttggagagggaatgctgattgtcttgaccaaacccacagcctgtctcttctcttgtttagttacttacggcaataaatcatctatgagttagtgcaccgtgaaaaaaaaaaaaaaaaaaaaaaaaaaaaaaaa

SEQ ID NO: 111 - DNA, 2105 bp, Homo sapiens
cattaaccaaacaaagagaagcagagtggatcctgtgctaatattgggaaaaccaggcaacaggactcatttggggcctttattgtgaaaacatgccccagctttcccaagataaccaagagtgcctccagaaacatttctccaggccgtctatatggacacagtttctgcccctgttcagggctcagagatataatacagacattcaccaaatcacagaaaatgaaggagacctcagggctgttcctgatatcaagtccttcccgcctgcacagctcccagactcgcccgccgccccgaagctgttcggcctcctttctagcccgctttccagcctcgcaaggttcttctctcaccttctccggcgaccccctcccgaggctccccggaggcgcctggacttctcccccctgcttcccgccctgccggccgcccggctctcgagggggcacgaggagctgccgggccgcctctcgctcctgctcggggcggcgctggcactgcccggccgaccctcggggggtcgtccgctgaggcccccccatccggtagccaagcccagggaagaagacgccaccgctgggcagagctcgcctatgccgcagatgggatcagagcggatggagatgcggaagcggcagatgcccgccgcccaggacacaccaggcgccgccccaggccagcccggagcggggagtcgcgggtccaacgcatgctgcttctgctggtgctgctgttgtagctgctcgtgtctcactgttagaaaccaggaagatcagaggcccacaatagcttcccacgaactcagagcagatcttccaacctgggaagaaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttgaaaaaaaaaaataaagggatatggctgttgtagaaagatagcgtatttgcatttacaataacagtagcatgttgtcagtggccaaggctacacagaaggctccctgctgcccggagcaggtacatccaccagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgcgtgtggatgtctacatggttaatggaaagcactgtgctctgaagtggatcagtctcaagtgtctggtaacagcagcagtgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaaagaaataaagcacaagaattttatctcaat

SEQ ID NO: 112 - DNA, 10583 bp, Homo sapiens
gacgcctggcgcacccgcgggagcggagccgtggcgcgctcgccccggacgccggccgcccctccgctcgccctactgagcgagcggcccggggcgccgaggggtccgcgccgcgcggggcgcaccgccctggccgccatgtgctcccagctctggttcctgacggaccggcgcatccgcgaggactacccgcaggtgcagatcctgcgcgccctccggcagcgctgctccgagcaggacgtgcgcttccgggcggtgcttatggaccagatcgccgtcaccatcgtcggcggccacctcggcctccagctaaaccagaaggccctcaccactttcccggatgtggtgcttgtacgggtacccacaccctcagtgcagtcagacagtgacatcactgtcctgcgacacctggagaagctgggctgccggttggtcaatcgcccacagagcatcttaaattgcatcaacaaattctggacgttccaagaactggctggacatggggtccccatgccagacaccttctcctatggtgggcatgaagacttttcaaaaatgattgatgaagctgagcccctgggctacccagtcgtggtgaagagcacacgaggccaccggggaaaagctgtttttctggcaagagataaacatcacctctctgacatctgccatctgatccgccacgatgtgccctacctgttccagaagtacgtgaaggagtcccatggaaaggacatccgggtggtggtggtagggggccaggtcataggctctatgcttcgctgctccactgatggacggatgcagagcaactgctctctcggtggcgtgggcgtcaagtgtccgctgacagaacaaggcaagcagttggctattcaggtgtccaacatcctaggcatggacttctgtggcattgatctccttatcatggacgatggctcctttgtggtgtgtgaggcaaatgctaatgttggcttcctagcctttgaccaggcatgcaacttagatgtgggtgggatcattgcagactataccatgtccttgctgccaaataggcagactggaaagatggctgtcctcccaggactgtcgagtccaagggagaagaacgagccggatggctgtgcttcagctcagggagttgcagagagcgtctataccatcaacagtgggtctacctctagtgaaagtgagcctgaactgggagagatccgggattcctcagcaagcacaatgggggccccaccctccatgctgcccgaacctggctacaacattaacaacaggattgcttctgagttaaaacttaagtgaattcctgctttttggcagcatttaaaccaaatcctactgcttccctagtagttttgagtgaataaaatctggactaatgtgatttcatttgcacagaaactagaaatcccatctgggcactcagcattttttctaacgatgatttaagcaaatggcctagctttgtggtttttacaaagacaaatataaaaacactcaagaacaacgtcccgactgatcagtatgagactgatgtctgctgtgagcacgtggatattacggctgacgctaaggcactgactctgctgttgcttctgacttttagcagtagaacccattagctcaaaatggctcttggaattatgtactcaaaagcaaccacgggatggaagcatgtgcagacgaggtggaatgtgactgcagtaataggttcttcactaagtgtgtgtgtgatgcttggaaaagacacagttcaaacactattagaggatcgatctctgctccccatcaatcaccatcttgaccatatttctccgacactcaggatatggtgttttagggagcttcctcattagcattttcagtgaagcactttgtagaaagtgagattgaacgttctttgacttcacaggttggcaaatgtcctgctttgtaactgggcctttctacaaattgctttgccactctgaatttatagaccctgcttcaactaacgtcagctctagcagcttcttgcacctttgctgcctttggcctcagctggaaatgcacttcaatgagctagtggccactcagtttatttcttaagcgtgcactagaatctaacaccatggactttgtttttcaatggactctgttcacttgtcatccagaagccagtgggtttttaccatagaaagctacttggagatcatcattcttcccctcctctactgaaactttgtgtactgcttagctgtagggggttttcttgtatgagtgggtgttggaggtctattgagtagatgggagccattggaaacactccaatccccttgaaactctacttttatctaagatccagacacctgtccttacccacttttccaaacggggaagactcaggtatcaggaattacccattgcacattttgcgggggggggggctaatgtagacatgacaccaagtgcttttcattttaattctctaagcagtagatgagatctttcccttgggagaaatcacagagatggagttttccatttctgcttatacgaaatatgactgaaaatgaacaaagccacctttttaaccaaatacactagaacatatgcactcaagagttagcataattggagttattttcttgatgttgcatgtgccaagaacacttagggttcccctttgggattacctttgaagccatgcaaggcaagaggcctcacaactttatagtcagaccttgtgttttatccaacccctcctcctgcccaccaagatcatcctgagctgcttcacccattttatttagcagacttattttctaatgctctttagctgttaaaaaaaaaaaatcattcctcaaaaaatagatctacccttaaaggacaaagatttaccaacactgaagacccttacaagttgacagtttctaaagagggttctaggaatgttctgtgtaaggtcagcttcactggaataaacatacatcttcccaaggtgactacttcaaaggcaacactacccattcgggtgcagaaattaccgtacttactctgccataaatgtaaaatgtgtataaagttaagctattgcattttttcataacacatttaaatagaaattggcttttaaagtattgtagttaaaaccagatctcaccaagtaatagttgtgcaattgacaaatgtttggtgccatgtaatggagatgtcacactacacagttgtagtttaaatgcagtccaacataaggtgcatgccactgaactgtaaccctagtaatgtgtcttgtacagttgaaaaataatacttcacctttatataggttaagatatgtaccttatctttaccactcagggtggctttaaaagacggacagctttaggtttgttctcactggaactggttacactttctgtgcaaacttaaccaagtgatgatcgtctggaagctgcattccctcatttccactgtttggtgtgaatctagtctccccactttatctaaaaggaggctagcagggccccagcctgagcagagcagctagagagtgcttccagattcctttgccaaaggaggcccattttccagctgtgagtgacatctgtagtcattggcttcattgcctggcactagccctgtctagaagtggagaaagctggatcacagctggaccacaaccagccccaatccaggatttcccataccatgctggctgtgggctctgtgagcctcagccaggtggccaggctatacttgtcacagctggccacaggcctgctgaaggaacatggggtgtagagccagagcctggttctggttctccgcttgaacagctgacctcgtgcaatcacaggaactctgcgtctccatgtttcactcagatagagaaaatgcctcctttgtttacctctttgaagctgaagtaagtgagactggtgcatgtaaattaatggtagtagagcacctcccacatctgattttataacagtttcccatcactccttaaagaaaaaggccaggccgggcgtggtggttcacgcctgtaatctcagcacttcgggaggccgaggcgggtggatcatgaggtcaggagattgagaccattctggctaacacagtgaacaaaaaattagtcgggcatggtggcgggcgcctgtagtcccagctacttgggaggctgaggcaggagaattgcttgaaccttggaggtggaggctgcagtgagccaagattatgccactgcactccagcctgggtgacagagcgagactccgtctcaaaaaaaaaaaaaaaaagccacacattcttggcattagcacaccaaacagtggtagggtaccctgagaaaggaatgcagcttctcagaggcctcacttccagccagggaaacttaagacctgaaaggaataaggctctttgtgtattcagacagccttctggatgtatcgtatataacctgaaactctccactcttgtataccaactaacaaagtcttccttatgtaacatagattgcagtgtctgtatatggtcttcccattatctggtagtagcatcttgaaactggtcaaaacttgaatgccaatagctcagtcactcagaatatacgattctgcacttgggaaaaatgtcttcatgctgtttttctgatcgggtatggggttgccagaatgaggatttggggctttaggtctttcggatctcagaaacaatataagtagatcataagccactagtgtcacaatttcaggcccattgcttccagctaaaaggagattccatgaccatggggaccaggagaggaggaaagggaaaagggaaaggtctggaatagttttgtgaaagaaataaaaaattgggatgatttggaattctagtaggaaggaggaaaaaatggctcttctgtgggctgttttaatgaaagaatcatgaatatgtattgatcagaggtagatgtctttgaagctgttctgcataaagataatgagatgcatggatttccatccaccctggagaagtgggggagatgtgcttcctcccttctttaaatcctgaggaatgctggtcttgagaacactgaatgcaaatctgaggaagatgtaagcggctggctggggagttttaggaccacccaaataaaagctgaccctcccagaggctaatgaaccacagtgctgtgtgcaggcatagccttagcaggtcagtttaaggagtcaggtcagagaataaatccaaccttagtcaagtcactacagtttaatattttcctttgcaactggaggtaagcctgtttgccattagtctgagtggatgtcttgggaaggcccctgaaaatagccatatttgtcactgtccctaaagtgaatgttcatagatctgggactgtttttgactgtacctctgagactcaagatcaggacagattgttactttaaaatgttacctggaagacgattcttctaagggctataatgttataatcttttcctaaaactaaatcatgcctccattccaggtctatggctagactctgcagccctccctcctaaaaccacagggctgaatgtggaaactttcttcttttaagcctttccatttccttctctaggtacagctcctgtgccaatatgcactgtctcaagccctgtgctggcattccaacctggtttggtaattttgctgtgaggttcatgttctctggggctccagggcaacactaagaaagtcgcttatgatccccatttgagaccatggaattagcattttggagaccagtctagtcccccatttcataagtagggaatcttacttagttccagaggccatgttcacttgctagtcaatagcaaggctggactcaggcagtctgattcctcatccactttggcatactgccagaggtagctccatccctccctggaatctagcacatgctcccatcctgggcctaccctccgcctcctccccttctgatgagcctctgttctggatcaacacggtgttgatgtgccagctgtcaagggttcagcacttggatggcttctaggtgagagccccaaaggcatgtatatttccatgatgcaagctggctcatggcccgcaccgtctttagaccagccaagaccatttaactctaccccacactttcagtggtgggatgtgaggaagaaagcccatgccaagctaactgaaagcttatttggctccaattcggctgatgttccctcactgcagaatgtcctggaaaccaagggtttgcagctcctaaacctattgcattaggcacacccaagaagaaatcctgttcgatgcacatgctccagtttcaatcagcaacaaggtcaaaagtttccccccactttctgttccacagtgcgttccccttgcagccagacattaggcacagattcatccctattgtaacccaaatgtcagctgagggctccttgcctcttgacatccagagaggtctgataactgggctctgtttctgaacctctagatttctgtgatttctcaaagacttatatttttgcagccactgctgactccacacttctgctacctcattttaaatagcgtcttatccctgcaatgcatcagctgagacatgaagctcagtttcctcgcccatttccacatagcaaaattcaagcgagtgagtgtgtgtgcctgcgtgtgtctcagtgacgtgggaaggaatggcagatgctacaacagtgcagactcggcaccccatttatagaatgttctttttatatactatggaggaatctccactcaccttccactccacgtggtccctgtctcctgtccttgggacagagcagttccatttatattctcacatacaaccagatggatagccattccttttcttaatttgattcctgccaacaccctaaccgtcatgacttcaccttttaccatgggtggcttattaaaaacattttcctggacgaagacagttccctccccaagcggaattcgagtgccatctcttaaggtgatgcatttttaattcccactgcacaagccaggcatcacaatgaccatattcaccactcgttgtcaggggtacaccttttggaaggcagcgtgggctaatgtgaatggtactagtctgagtcagatccagttcaaatccaggtaacttaaagcttgtgtgacccagggacactttacttcaacttgttaaaccttaattttgtcacctataaatgtgatacataaacaaacttgaatgtgtcgcacttaaccacatgcctggctttccataggttcctttcctcttgcttcccccactgtgagcaacacaagcatcgccttcttgtgatcatggctcagtgccaagggataaaagctggcagacagcagctttacagctgggaaaaagagctgctgggggcagggctggcggtagctcaagcatgctgtggttcaggctaatgactggaaggtcccatccatccttgagattttatgacgctatgtgcaagatctagcgaacgtatttggctaagaaaaatcctggaggagagactgcctcagacaactggggggctggaaagccgacctggaaagcagcctgaccttggatgatttagcacctgggttttttggctcttcctgtattaggtttgctggcttcgcatcaaatggaaggaggtggtgccagggacgtgaattaaacctgtcaaatagagggtgaggggagtgcagaaggctgggggaaggaggggctgtgtggggaactctgatagtctgacagcaccatctggacttggcagggatgacagccctgagatcagatggaactaaccaataaagctgctaaaattctgctgtcctgggcctatccggagtgggactcccgtaatctcctatttagaaggaacactgatctgcaaggggagagctggggcccttaatcattctgcagagctgataacggtcactgtggaggcaggactaggcgggtgcctggtttgcttagtcccaccttgaggtcccgagttccagtggtgtgccgaagtggtttgcactggcccatgagagtggattgttgaatttccaggaattttgtaagctggttggtaaacacagccacagtgaccattagagattatattaacctgcaattaaataaagtatgttaaaaacagtaataaatactcaaaactcatcacttcctaattattttactattatctatgttcttgaggatactgacatctattgtattggtatggtgtgctacaatataatggcgtgctattgcacatctcttcccaacctgaacattcagtgacatcacatcagtagctggggaatcggccctattgagagtatttacaccacagagattggcaaacactctatatcaagacccccctccccgagagctggttgttaaacatttgtcagcacaccactgctgctgggagacagagagaagaaactgatacacgtgagcactgaaacatcttagttccagggaggtagcatttgtgttgtatttctcagaagcaagtgtcctagtgtaatgtgcacaagtggcatgaagtttaacacctaaaagactgcttctctgcttgttctgtctaacttctgtgatttcaacacttgagaaagatgtttactttgctactaaacttattggagtgatttgtaaagttcactgtcacctgtgggcagtagttcagctaaattccctccaggaaagtggactgtagcttttcctgcctaactggcaaaatgaaaatatgctgaaaagaatacatcttaactaggcaccagaatagctcatttccaagtggtttatacagcaataacagtgttaacttctccaacagagacgaaatcatttataaatgattgttttgctgtttttgctttttattaaaattattactatggaacagaatgctttgtttgcctttgtctccaaaattctgtgccttttggtggttcttgtaaagtaagaatcacatgctgaatctacattttattattttcatatcataaaatgaggaagagccttcacagaagaaacttcaccctattcacttgcacaccagctgcgttctgaaaaactataattttcctttcaaacgcagagtgccgtctgaattgtaatactgccaactctcaactgtcaagatgatggaggaaaatactaatgcagatggcgtgagcttgtcacgggcctgctcagcgtgctctcccgggctgacattcgaattaagattcaaatagcaagtgagagctgaaagctgtttaaaatggctgtgtggtgcagtaaggggtctcaggggattgaaagaatctgtgtactcaccagaagaactctgacaggtcaggcagggccctcaggacttgtgtttgcctgacatttcaagaggcttcctgggagaagcggtgataagaccctgggggactaacagtcaaaacaaggctcaagacccttgaactaaggctattccccagcttctgagggtcagggagtccaaattgaggtcagagcatcaaagggatagtgcttgattgctgcagccgaggatgatttggggtatgacattatgtaccattcatattgtccttgaacccaaacactggggaatgtggcctatgtttctttcttcttctcttacatgaaaatcgtcaaactacacaaaagtggagagaatagtaaactccccagaaaaggacgtttccatttgcctttaccacatataaaaagattagcagtaatcccttgataccatctaattcccagtccgtattcaaattcccccattgtctcaaagagaactgcatttagctccatggtagaccagcgtatttggtgagaaaggaagtactttggaaaggttgctgatggcttccctaccctcttgacggtggctctggcagaaaccatgctgcaggggcacaggtggagagatgttcaggctggctgcagatgcctttccaagttgtgggatcttgggatttcctctcctcaaagaataagcctgtgacacttccccttctacttcccagagttacatggtgtccctctaggactctcccagcttcatgctgctggcacccacttgtctatcacgctggtatccgctgcttttcctgcagctgctgctttcactaatggcacttcttaaatctggtgagaggcttctctcaaaaatgatcgctcttccactaaccttaggtctactgtactcttggtgaatcacagctctttagagctcctcaagggcctaagcatcttttgttagaaaattctggctgaaattctcatgagatgggtcagggaaccttggagtggcagcacttgtgtcacatctaaaggcactcctctgactaaagagaagtggcagctgagcacactgcctgcccagggattttcttctgctctaaaggacattattaagacaactggtctgtactgtattgcctgatagtatcatatcaatgtcaatttcctcattttggtgattgttctaataagaatacgtaagaatgtgtccttgtttttagaaaatacacattaaatatcgagggatagagaaaaaaaaaaaaaa

SEQ ID NO: 113 - DNA, 3631 bp, Homo sapiens
tgagtcccggccggagccccacggccgcgggcggcgcctaggacggcgatccgcgccctggaggatccgccggccgcccggctccactacagctccagccgcctgcagcggggccctcctgaggccccagaggaagagaccatgaaagtgaggtcggccggcggcgatggagatgccttgtgcgttacagaagaggacctggcgggtgacgacgaggacatgccgaccttcccatgcacccagaagggccggccagggccccgctgcagccgctgccagaagaacctatctttgcacacatcggtgcggattctttacctcttcctggccctgctcctggtggccgtggctgtgttggcctctctggttttcagaaaagtggactctctctccgaagacatctccttgacccagtctatttatgacaagaagcttgtgttaatgcagaaaaatctccagggcctggatccgaaagccctgaacaactgctctttctgccatgaagctgggcagctggggccagagatccgaaaactgcaggaggagctggagggaattcagaagctgcttctggcccaggaggtgcagctggaccagaccttacaggcccaggaggtgctctccaccaccagcagacaaatctcccaggagatgggcagttgctccttctccatccaccaggttaaccagtctctggggctcttcctggcccaggtgagaggctggcaggccaccacagctggcctggacctctctctgaaggacctcacccaggagtgctacgatgtcaaggctgcagtgcaccagatcaacttcaccgtggggcagacttccgagtggatccacgggatccagcggaagacagacgaggagaccctgaccctccagaagattgtcaccgactggcagaactacacacggctcttcagcggcctgcgcaccacctccaccaagactggagaggcggtcaagaacatccaggccaccctgggggcctcctcacagcgcatcagccagaactcagagagcatgcacgacctggtactccaggtcatgggcttgcagctgcagctggataacatctcgtccttcctggatgaccacgaagagaacatgcatgatcttcagtaccatacccactacgcccagaaccgcactgtggagaggtttgagtctctggaaggacgcatggcttctcacgagattgaaattggcaccatcttcaccaacatcaatgccaccgacaaccacgtgcacagcatgctcaagtacctggatgacgtgcggctctcctgcacgctgggcttccacacccatgccgaggagctctactacctgaacaagtctgtctccatcatgctgggcaccacagacctgctccgggagcgcttcagcctgctcagtgcccggctggacctcaacgtccggaacctctccatgatcgtggaggagatgaaggcagtggacacacagcatggagaaatccttcgcaatgtcaccatcctacgaggtgcccccggccctccaggaccaagaggattcaaaggagatatgggcgtgaaagggcctgttggcggcagaggcccgaaaggagaccccggcagcttgggccccctgggaccccagggtcctcaggggcaacctggagaggccgggcctgtgggagaaaggggccctgttggccctcgagggttcccaggcctcaaaggctcaaagggcagctttggaactggagggccgagaggacagccaggcccaaaaggggacatagggcccccagggccagaagggcccccggggtctccagggccctcagggcctcagggaaaaccgggaattgcagggaagacagggtcaccaggccagcggggggccatggggcctaagggtgaaccagggatccagggtccccctggtctcccggggcctccaggtccaccaggaagccagagcttctactgaggagggctgtggcagagccactgtcacacagaatgccggaggggcgcagagcagatccaggccccagaaagcctcacctacagacagctgtggtcctctgattccaatgagggggctccccagggctgaccctgcagctttgggctcccccatagtgactgtgccataggaaagcagcccctcctcacacatacatgtgcacatgcacacacatgcatgcacacacatgcacacatacacgcacatgcacacatacacatgcatgcacacatacacaggcatacatgcatgcacacacacatgcacgcacacacacatgcacacatacacgtgcacacatacacaggcacacatgcatgcacacatacacatgcacacacacatgcacacatatatgcacaggcacacacatgtacgcacacacacatgcactgcacacatatccatgcacacaaacacatatatacacatgcacatacacagatttttctgctggccaggtgggccaactgggtttccctggctgggcaggaggagagggcagaggaagaccccctctcctgtgactgagcctgccagggaggcagctacctcgggaggaaggtctcacatctgtctctgggcacccatgctggccagcagtttcccagggctccctggggttgaaaagccccaaggaaacctttgcgggtggggcgttactgccaaaactccagaggcaaagtggacctggcaaccacaagaccctccccataagcaggggaccagcatacccgggagctgtccctgtctgtcacagcacagtggggccacgaggctgacattctctggccttgcacacagtgccccctgagaagttcaacatttatttcttcacgtgtccagaaaattcctcaattcatccttgcctctgcccttcaggagcagcctggaaggaatccaagcaggagtttcatctgcatgggggcactctgcaggccctggaacattgggcctgagtggagatgggagacagaggcaggccagaaggttctctctgcacagctgcctcccttgctctccctgaggctggcctgccccattccccaagggggctcctctggagtggtggggaggattaggctgcagaagggccaaccccttgcaacagggcagctctcgcctcccgcacacggctctcctgatcacagctgcatgccgaccttgtcccaccgggacccacaatggcccgagccctctttgcatgggcagccagctggactaggagtgggaagggcctggacactcacagaggccccctctgtcatcactccttggcacccaccaacttcctgcacacactggcagagaggggcgctgggaaatcaccccacagggtggaggtctcctgttggctacactctaaagctgctttgccttcatgttcaaacagattcaggcaccaccccctccaccgcccgcaaggttagggcatagagttgtctccttcccaacacggacccagagagcagcccttccctgctcaaagcctttccgcaccctcctgactgtcctggatgtgcaactggtttgcactgcacaccccacggccatgtaactctcctgtccacatatgataataccattctgcatagtattactgactcagtaaagagctatttccaggagt

SEQ ID NO: 114 - DNA, 3345 bp, Homo sapiens
cttgcctgtctgcgtctaaagcccctgcccagagtccgccttctcaggtccagtactcccagttcacctgccctcgggagccctccttccttcggaaaactcccggctctgactcctcctcagcccctccccccgccctgctcacctttaattgagatgctaatgagattcctgtcgcttccatccctggccggccagcgggcgggctccccagccaggccgctgcacctgtcaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctgcaaccaggcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctgggggtactgctactataagctccaggttgacttctcctcagaccacctgggctgtttcaccaagtgccggaagccatgcagcgtgaccagctaccagctctctgctggttactcacgatggccctcggtgacatcccaggaatgggtcttccagatgctatcgcgacagaacaattacaccgtcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaagggtacacgcaggcatgcacgggtttcctgcccagcgacggcttaagccagcccccgactggcctggccacactgctctccagtagcacagatgtctgctcctcctcttgaacttgggtgggaaaccccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgccttctcctgggctcccgtagcacactataacatctgctggagtgttgctgttgcaccatactttcttgtacatttgtgtctcccttcccaactagactgtaagtgccttgcggtcagggactgaatcttgcccgtttatgtatgctccatgtctagcccatcatcctgcttggagcaagtaggcaggagctcaataaatgtttgttgcatgaaggaaaaaaaaaaaaaaaaaa

SEQ ID NO: 115 - DNA, 3207 bp, Homo sapiens
ggcccacagaggagcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaatgtcagatgcgtgcccagctcttcaccccccaatctcttggtggggaggggtgtacctaaatatttatcatatccttgcccttgagtgcttgttagagagaaagagaactactaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttcaaaaaaataataaaataaataaatacgaagaatatgtcaggacagtcaaaaaaaaaaaaaaaaaa

SEQ ID NO: 116 - DNA, 2333 bp, Homo sapiens
agtaggacccaggggccgggaggcgccggcagagggaggggccgggggccggggaggttttgagggaggtctttggctttttttggcggagctggggcgccctccggaagcgtttccaactttccagaagtttctcgggacgggcaggagggggtggggactgccatatatagatcccgggagcaggggagcgggctaagagtagaatcgtgtcgcggctcgagagcgagagtcacgtcccggcgctagcccagcccgacccagaatgaaaaaggcaggcattgacctccctctgaggcagtttccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaaacagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgacattttgttggagcgtggaagaaaaaaaaaaaaaaa

SEQ ID NO: 117 - DNA, 2157 bp, Homo sapiens
acaagtcccagcatccaccgcgcggcccaggactgtcagggtagtgggcgttgcgtgaggcgggtaaatgttcgcggaagcggcaaagacgacacggccttgtgggatggcggagtttaaggagaagcctgaggccccgactgagcagctggatgtcgcgtgcggccaggaaaacttgccggtgggcgcgtggcccccgggggccgcgccggcgcccttccagtacactcctgatcatgtagttggacctggagcagacattgatcccactcaaataacctttcccggatgcatttgtgtcaaaactccctgcctccctggcacttgctcctgtctccgccatggagagaactatgatgataactcatgccttagagatataggatctggaggaaagtatgcagagcctgtttttgaatgcaatgtcctgtgccgatgcagtgaccactgcagaaacagagtggtccagaaaggtctacagttccacttccaagtgttcaagacgcataaaaaaggctggggacttcgtaccttggaatttataccgaaaggaaggtttgtctgtgaatatgctggtgaggttttaggattctctgaagttcagagaagaattcacttacaaacaaaatccgactccaattacattatagccatcagggaacatgtttataatgggcaggtaatggaaacatttgttgaccctacttatataggaaatattggaagattccttaatcattcttgtgagccaaaccttttgatgattcctgtccgaattgactcaatggtacctaagttggcactttttgcagccaaagatattgtgccagaagaagaactctcttatgattattcaggaagatatcttaatctaacagtcagtgaagacaaagaaaggctagatcatgggaaactaaggaaaccttgttactgtggtgccaaatcatgtactgctttcctgccttttgacagttctctgtactgccccgtagaaaagtcgaacatcagttgtggaaatgagaaggaacccagcatgtgtggctcagccccttctgtgttcccctcctgcaagcgattgacccttgagactatgaaaatgatgttagacaaaaagcaaattcgagcaattttcttattcgagttcaaaatgggtcgtaaagcagcagaaacaactcgcaacatcaacaatgcatttggcccaggaactgctaacgaacgtacagtgcagtggtggttcaagaagttttgcaaaggagatgagagccttgaagatgaggagcgtagtggccggccatcagaagttgacaacgaccagttgagagcaatcatcgaagctgatccccttacaactacacgagaagttgctgaagaactcaatgtcaaccattctacggtcgttcgacatttgaagcaaattggaaaggtgaaaaagctcgataagtgggtgcctcatgagctgactgaaaatcaaaaaaatcgtcgttttgaagtgtcatcttctcttattctacgcaaccacaacgaaccatttctcgatcggattgtgacgtgtgatgaaaagtggattttatatgacaaccggcgacgatcagctcagtggttggatcaagaagaagctccaaagcacttcccaaagccaatcttgcacccaaaaaaggtcatggtcactatttggtggtctgctgctggtctgatccactacagctttctgaatcccggtgaaaccattacatctgagaagtatgctcaggaaatcgatgagatgaaccaaaaactgcaacgcctgcagctggcattggtcaacagaaagggcccaattcttctccacgacaatgcccgaccgcatgttgcacaacccacacttcaaaagttgaatgaattgggctatgaagttttgcctcatccaccgtattcacctgacctcttgccaaccaactaccacgtctttaagcatctcaacaactttttgcagggaaaacgcttccacaaccagcaggatgcagaaaatgctttccaagagttcgtcgaatcccaaagcacggatttttacgctacaggaataaaccaacttatttctcgttggcaaaaatgtgttgattgtaatggttcctattttgattaataaaaatgcgttgagcctaaaaaaaaaaaaaaaaa

SEQ ID NO: 118 - DNA, 3129 bp, Homo sapiens
ggcacctcccttaggcgccagggacagccgagcgttacctggtcccgggcagcggagttctttacccaccccagttctggttctgacgccctagctcattccgcaaatttagggcttgggtctggcttgttcccctccggctcgaaccacctcttctctgagccgagccagctaccggggctcctggaattgccacccctccctgggcacccttgaggcctccgtggagggacgtcacggggcagagcgggacgtgagcctgagtttgctgcaggcgtgctctgtgtggtggctgggttctgccaatccccgtgcccaccgggtgggcgcggccgggaagctcctgcccctccctgctggtcggcgtcacgcgtgacgtcccgcgtgatggctgggagggcccggcggcgacagcggaggcagagaggaaggcggttctgagagcttcagagagcgatggaaagcaaaatgggtgaattgcctttagacatcaacatccaggaacctcgctgggaccaaagtactttcctgggcagagcccggcactttttcactgttactgatcctcgaaatctgctgctgtccggggcacagctggaagcttctcggaacatcgtgcagaactacagggccggcgtggtgaccccagggatcaccgaggaccagctgtggagggccaagtatgtgtatgactccgccttccatccggacacaggggagaaggtggtcctgattggccgcatgtcagcccaggtgcccatgaacatgaccatcactggctgcatgctcacattctacaggaagaccccaaccgtggtgttctggcagtgggtgaatcagtccttcaatgccattgttaactactccaaccgcagtggtgacactcccatcactgtgaggcagctggggacagcctatgtgagtgccaccactggagctgtggccacggccctgggactcaaatccctcaccaagcacctgccccccttggtcggcagatttgtgccctttgcagcagtggcagctgccaactgcatcaacatccccctgatgaggcagagagagctgcaggtgggcatcccggtggctgatgaggcaggtcagaggcttggctactcggtgactgcagccaagcagggaatcttccaggtggtgatttcaagaatctgcatggcgattcctgccatggccatcccaccactgatcatggacactctggagaagaaagacttcctgaagcgccgcccctggctgggggcacccctgcaggtgggactggtgggcttctgcctggtatttgcaacccccctgtgctgtgccctattcccccagaagagctccatacacataagcaacctggaaccagagctgagagctcagatccatgagcaaaaccccagcgttgaagtggtctactacaacaaggggctttgaggagggtcagcctctgtcccctccctcacttccttgggctgctgctttagtggagtcatgtcacccctaccacttggctatctgcctagcactgggcaggggccttggtgggcagatggcaattgagggtagcaacctattagggtgggggagggacctccataaggcttttcctcccttctctggtttcaaagatcagagcacataacccctcctgtgcttgagtgtccatgcatatacatacatgatacacatgtgtatgtgtacattgggtcctgaaagctagaagcaggcatgctagcctagtatgttctgacatctggcttcccttctcagcctcatgtccacctgcctgccagccaggctacaggtgtgacttccttctctaaactgttacaccagccaagttatttttgatggcacctcatcccttctagaaataggaggagccccaggatctcaggacagagacttatagacactagtaggacaaagcgggctgaatccttcaggtttctgatacctagctccccaagctgactgggctggcagaggagaacatgttgagacaagggaggcaggggacttatgcatccctcagtgccatcccttgtatcctggaatagctccatttcccctcctcctctctaccagacaaaggagtgcctgtgtcctgtactgccctcgctgtctcccccaccaccctacttgacagcgtgggcatcttcaggcacagccttgggagttcctggtgtgctctgacatcatgacctcaaatctaaatcctccaatcccaactccctttcccaaacaaaaagccacagaggcagagcaagcattcccctttaagagcttccactgcaccccctcccaagggacacagcggtaggaatggtgcttaaactccacaggtatcagagagggtgtaactaggacatcctcaagggcagctaggccccgaatgtacaatgttaagacagggaattttgtgttccattgacttttttttttttttttaatggagtttcactattttgcccaggctggagtgcgatggtgcgatcttggctcactgcaacctctgcctcctgggttcaagtgattctcttgcctcagtctcccgagtagtggaaattacaggtgtgtgctaccacatcttgctagttttgtatttttagcagagatgggggtttcaccatgttggccaggctagtctcgaactcctgacctcaggtgatccacctgccttggcctcccaaagcactgggattacaagcatgagccactgtgcccagcctgttccactgacatttcttagacattcagcaaaacccccaccttaacctcttttctttcttgagggttggtcctgtccccacctccaccctcccaccccctggaagaggaagggcccgggcatcagtggctagtccaaataaaatatgggcttggggatggaatgggtggtggtaagttcacagagtgtagttagatcccaactcccatgacctctggcttcagtggtgggtggggcagggcagatgaaagggcttcagtgggaacctctgagagcattttcctgttccccctatcaaccgcccccagtgataacatctgtgaagccagccattactcaataaactgcaaacttgtctaaaaaaaaaaaaaaaaaaaaaaaaaaaaaaaaaaaaaaaa

SEQ ID NO: 119 - DNA, 2616 bp, Homo sapiens
atggacggcgagagcgaggtggatttttctagcaacagcataacccctttgtggcggaggcggtcgattcctcagccccaccagcttctgggccggagcaagccgaggccccagtcctaccagagccccaacgggttactaattacggatttcccggtggaggacggagggacgctctccgcagcgcagattcccgcccaggtgcccaccgcctcggacagcaggacggtacataggagccccctgcttctgggcgcccagcggagagcggtggccaatggtgggacggcatccccggagtacagggctgcctctcctcgacttcgacggcccaagtcacccaagctccccaaagcggtgcctggcggctccccgaaatccccagcaaatggcgcggtgaccttgcctgcgccgccgccgccgccggttctgcgccccccgcggactcctaacgcgcccgccccctgcacccccgaggaggaccttactgggttgactgccagcccggtgccttcgcccactgcaaatggccttgccgctaataacgactctcctgggtcaggttcgcagtccggccggaaggcaaaggaccccgaacgggggctctttcctgggccccagaaaagttcttcggaacaaaaactccccctccaaaggctgccctcccaggagaacgagctcctcgagaatccttccgtggttttgagtacaaacagccccgccgccctcaaagtggggaagcagcagatcattccgaagagtctggcctcggaaattaaaataagtaaatccaacaatcaaaatgtggagccccacaagagactcctcaaggtgcgcagcatggtggagggcctaggaggacccctgggtcacgcaggggaggagagtgaggtcgataacgacgtggatagcccagggtctctgcggagaggcttgcggtccacgtcttatcgcagggcagtggtcagtggctttgattttgacagtcctaccagctcgaagaagaagaacagaatgtcccagcctgttctgaaagtggtgatggaagacaaggagaagttttccagtctgggaaggataaagaaaaaaatgctgaaaggacaaggaacatttgatggggaagaaaatgctgtcctgtatcaaaactacaaggaaaaggcccttgacattgattctgatgaagagtcagagcccaaagaacagaagtcagatgaaaaaattgtgattcaccataagccattgagatccacatggagccaactctctgcggtgaaaagaaagggattatctcagacagtaagccaggaggaaagaaagagacaagaggctatctttgaagtcatatcctctgaacattcatatttactcagcttggagatcttgatacgaatgtttaaaaattctaaagaactgagtgatacaatgactaaaaccgagaggcaccatcttttctccaatattacagatgtctgtgaggcaagcaaaaagttctttatagagttggaagcaagacatcagaataatatcttcatagatgacataagtgacattgtggaaaaacacacagcatccacatttgacccatatgtgaaatactgcacaaatgaagtctaccaacaacgaacactacaaaaattgttagctaccaatccatcctttaaggaagtattgtcaaggattgagtcccatgaagactgtaggaacttacccatgatctcttttctcattctccccatgcagagggtgacccgccttcccctgctgatggatactatctgtcaaaaaacacctaaggactctccgaagtatgaagtctgcaaaagagccttgaaggaagttagcaagttggttcgactatgcaatgagggcgcccggaagatggaaaggactgagatgatgtacacaattaactcccagctggaatttaaaattaagccttttcctttagtctcctcttcccggtggttggtaaaaagaggtgaattgacagcctatgttgaagacactgtgcttttctcaagaaggacatccaaacagcaagtctacttctttctctttaacgatgtgctcattatcaccaagaagaagagtgaagaaagttacaacgtcaatgattattccttaagagatcagctattggtggaatcttgtgacaatgaagagcttaattcttctccagggaagaacagctccacaatgctctattcaagacagagctctgccagtcacctctttactctgacagtccttagtaaccacgcgaatgagaaagtggagatgctactaggagctgagacgcagagcgagcgagcccgctggataactgccctgggacacagcagcgggaagccgcctgcagaccgaacctcactgacccaggtggaaatcgttaggtcatttactgctaagcagccagatgaactctccctgcaggtggctgacgtcgtcctcatctatcaacgtgtcagcgatggctggtatgagggggaacgactacgagatggagaaagaggctggtttcctatggaatgtgccaaggagataacatgtcaagctacaattgataagaatgtggagagaatgggacgcttgctaggactggagaccaacgtgtag

SEQ ID NO: 120 - DNA, 3416 bp, Homo sapiens
ctggagagcctccaggcgcccgggtggggccgcgattgcgccccgccagtcaccccggcatgtgggcgcggcggggcggcgcgggcgggacggctacaagagctgttttgcgtccgggccggagtatttgctcagcccgcctgcgccgcttgggacgcctctgcctttccctccctcccttccccgacggcttctggcggccaagtggatgtggcgggtgatcgagccaccctgcccaggggcgcccagcactggttcagtgaacagcattttggacaggacatttggtgccaggtctgagtagccagtttgctgaattattgtcccagtcagccaggattgtgagctgtttgggaagtttcgtggaaacgcccaagtgccagcacaggtggagggacacctggaggccagtttcaggaacttttgccacaagtataaaagacttcagaagtgcaaagatgctgaaacagatactgtcggagatgtacatagatcctgatctactggcagagctcagcgaagaacagaaacagatcctgttcttcaagatgagagaggaacagatccgacgatggaaagaaagagaagcagctatggaaagaaaggagtccctgccagtgaaacccagaccaaagaaagagaatggcaaatcggttcattggaaacttggagctgataaggaagtctgggtatgggtgatgggcgaacaccatctagataaaccctatgatgtgctctgtaatgaaattattgctgagagggcccggctgaaagcagaacaggaggcagaagagcccagaaaaactcactctgaagaattcaccaatagcttgaaaacaaaatcacagtaccatgatctgcaggctccggataaccagcagactaaagacatctggaagaaagtggcagaaaaggaggaactggagcaaggatcgaggccagcaccaaccctggaagaagagaaaatccgatcactctccagttcttcaagaaatattcaacaaatgttggcagattcaatcaatcgtatgaaggcatatgcatttcaccagaagaaagaatctatgaagaaaaaacaagatgaagaaataaatcaaatagaagaagagagaacgaagcagatttgtaagagctggaaagaagactcggaatggcaggcatctctgcgaaaatccaaagcagctgatgagaagagacgctccttggctaaacaagcacgagaagactacaagaggttatccctcggggcccagaaaggaagaggcggtgagaggctgcaaagccccttgcgtgttccgcagaaaccagaaagacctccccttccacccaagcctcagttcctaaactcaggggcatatcctcaaaaacctcttagaaatcagggagtggtgaggacactgtccagctctgcccaagaggacatcatccggtggtttaaagaggagcagctaccacttcgagcgggctaccagaaaacctcagacaccatagccccctggttccatggaattctcacactcaagaaagcaaatgaacttcttctgagcacaggcatgcccggcagttttctcatccgagtcagtgaaaggatcaaaggctatgccctgtcctatctgtcggaggacggctgtaaacatttcctcatcgatgcctctgcagacgcctacagcttcctgggcgtggaccagctacagcatgccaccttggcggatttggtggaatatcacaaggaggaacccatcacttccctggggaaggagctccttctctatccctgtggtcagcaggaccagctgcctgactacctggagctgtttgagtgacagcctccatcagggtcatcctacagcctccaagcgggctttcccctggacaaatgccactgcaacatttatgtgtgaagccaaaatcaccctgcagcagagccaatactgatcaactgaaagtaaagtatccatggagtcctcattgacacctcttttctgcacaaatactggaattcaatgtcaagagaaaatgacctctgctcaaaagggagaagagtctcaatttcagcaagtacctgtcatgaagggtatgaccttaatgatgtacataaaataaaacaaatgaagaaatggaaaacttttagaaattaaggtgtacttgaaaacgaatatctatcatatgacccctgcactccctctgtatcatctcaggaggtttcaggggcctgttgacatgaagtttcgaagtttcatgttggctttggaatggtagcaaaagcctttcctggctgagatgatgcttaaaacacacctcacttattgtacatgttggaaccaggacatgagagacatagaaaaacagaagtcatgaatgtaaattgaatgagaggcttaacatgcatgaaaatacagatggacctgcaggaaagtgagcaaacatcgctgagtttgttttcttgttcgggagaatggggccggggctggcctggcctcccctggatatactctatagtgcaccaaaaggataaagcatctgtacatgtatttttttattttttatcagaagtgcttagacaagaacagaataagcaggctgtttggatgctacttgtggttgaattgtgttcccccaaaatatatggtgaagtcttaacccccatccccgtgaatgggaccttgtttggaaatagggtctttgcagatatagtcaagatgaggtcacattggattagggtgggccccaaatccaatgactggcatccttaggagaagagagagttttggtaatagacacaaatgcagtgggaagaagaccaggggacaagaggcaagttggagtgatgcagccggaagggaagggacaccaaggatctccggccaccagcagaagccagcagagaggcatgggacaggttccccacaagccttagaaggaagcatggccctgacttcagaattccagactccagaactggaagaataaatgtctgttgttttaagctgcttagttcatgctgagttcatgctgacttgttactatagccccagaaagctaatacagtcgtttatgtaattacataacctgacacacaagatcgacccattcactgctgcccagtccaccattttcataatgaagtagaaatgggaggtaagaaaaacattccagccagttctgtttagccctggcacacatatttgtcccgtcaggaatcttatgccctcctggaacccccgcccacctcagtccagtcccagtcaggcgaacggcctctggacagggactgaggtggctctgagccactggagatcatttttcttggaggatggagattggctagtacctctggcctaactgtgtaggtcaatactcttttacattgccttctaataaaagcagaatgatacagcaaaaaaaaaaaaaaaaaa

SEQ ID NO: 121 - DNA, 3834 bp, Homo sapiens
actcacaagggccgggcccgaaccaccctgagcgcctcctccgagccaggctcgatccttcacactgggaacggagacactccggtccagtgtcacttgtcctcgagtaagaggagagggatgacaggcgagcaacggagtcacaagggctctgcagagaatgaagcgtgagtggtggtcgtggaaggcttcccggaggaggcggtgcggtagccgcggctcggatgacgcggaggagccagccagagaggggaggggcagaggccctccaggaggagggacccgtgagtgaggcgcgggggattcagcgcccccagcccgggaggaggtgccttctgagctccgggcgagcccctcccgcccttccaggcggagcgccgggcgtgggcagtgccagggcccctcgcggccgctgattgggtggtgcggccgagcggagcggctccgcgggcgccgattgcctcccctcccgtggagctggaagccaggcaccctgggggccatgcagaaggcgggggctgggggccgcagggcctctgactgcgggctggcccctcaccggcccaggtgcatcaccaagtttgcccagtacgtgggctccttccctgtggatgacctggacacccaggagagcgtgtggctggtgcagcagcagctgtgggcgctgaaggactgtccccgacgccgggccgtcatcctgaaattcagccttcagggtctcaagatctacagcggggagggtgaggtgctgctgatggctcatgccctgaggcgcatactctactccacctggtgccctgccgactgccagtttgccttcatggctcgaaacccacggagcccagccagcaagctcttctgccacctctttgtgggcagccagccaggagaggtccagatcctgcacctgctgctgtgccgctctttccagctggcttacctcttgcagcaccctgaggagcgggcacagccagagccctgcccagggcccacaggggaggtgcccctgaagccactgtccagctctgggggcctggtgcgggagcccttcggccgtgatcagctctctcagaacgtccatgccctggtctcctttcggcggctgccagcagaggggctggtgggcagtgggaaggagctgccagagtcggaaggccgtgcccgccatgcccgcctggggaatccctactgctcgcccacgctggtgcgcaagaaggccattcgcagcaaggtgatccgctcgggggcctaccgcggctgcacctatgagacccagctgcagctgtcggctcgggaggcctttcctgccgcatgggaggcatggccccggggtcctggtggccactcgtgcctggtggagagcgagggcagcctgacggagaacatctgggccttcgctggcatctccaggccctgtgccctggccctgttgcggagagacgtgctgggggccttcctgctgtggcctgagctgggtgctagcggccagtggtgtctgtccgtgcgcacgcagtgcggcgtggtgccccaccaggtcttccggaaccacctgggccgctactgcttggagcacctgccggcagagttccccagcctggaggctctggtggagaaccacgcggttactgaacgtagcctcttctgtcccctcgacatgggccgcctgaaccccacctacgaggagcaggactgtgggcccccaggcaggccgccccggactctccggcccctcagccatgccaagtccgaggcagagctgcagggcctgggctaagaggtagggccccggtcccacaggccccgcctcaccccggctcctgggccccagcagcatctctgcccgtcctgcacccctctggttgccagttccatccagtcaccctgcccttggagcagtcttccatcgcgtcactgtccgtgggaggggagccctgagggtgggtatcgccaatggcttcttggagaacatgtggcctgctgagattccaggagggcaggtggagttgcaggcttcggataaccctttgggtggcttcggatgacctgctgtgtggcttcggatgctttgggacttctgggcttctgctttactcctggggcaggagcttgttcacggcaaagctgcagccctctcctaaggaggctaggccttggggcgctgactgggagtctccagaaagagggttttggggaggcaggagtgagcttttactctgggcaaagacctggagtgagccaccctgtctatgagagcagagatgactccatggagcttgtgggcaggaggctggggatgagccccatctaggctgacagagcagggctgtttctcatatgtatctgagagtgaaggaggggtgggaaggtgcagagagggcaggagggacagagggctgtacctaacgctcacgcacggtggactcctgtgtgcagaaagggatgcgcaccagcagacagggccaagaatctccatgctgtctccactcaaaacctcagggctgtgactcccgctttctcagaagggatgcgcaggctcaccccttccccctaggaatcaccagggcacccccacccccagctcatctcctttagccatttgacagggaggggccagcagtgagctgcaggcttagaggggtgaccagggcccttcctaactcgaccgcatgtggtttggtggctgccttgggagggaggctgtccgatgctgacattccccttagcatggccctgaccgtggctgtcaggggccaccttgcctcaccaggccagccccactgggaatggggtcagtcacagcagaaccgtcgaaaggtggacctgatgtgggccctgccgggggcgcttggcctcagcgggccatgggagacccagggaaacgactctagtgtgaggcagtggtcctgccagtgactgacaaaccctctttgtaagcaaacttgacaaataatgaatctactgaactctgttatagaacaagttcattttgcatgaacttctcttattgaagcagaagccacgtcatgagcctgggggctgccctctccccgtctgggagtgggacagaactgttcagtgccttgaaagtcacagatttctgactcctggaaggaactgggcagtcccaccagagcagaaagaaaggaggcaaacttggggagtgagaagccagcctcccagaggcccaggcctcgtgttccccacctccaaccctcccgtgaggagaggggcttggcctgggaccttgtaacttccttgcaagttaagtgagctatcctgtcacaaaagatagaaggaactgccctttgggacttcttttcactggaaacccagcactggttttatgttgagtgagtgggaagctgggactctgttttacagccatctgtactggagcctggacaaaccactggtctctatgggaggccccagcctcacatttccctggcaaggagagagaggtttagccatgtcctgggtctaggattacagcccagagatgggcacttaagaagacctggtcattggtccagacttgggccaaggctctcctctgtgagggatgggttttactggtgaattacctgtgtggagaagctatcagggccatgtttagcacactgaagggaccagtctccaccaagcactttaacatccctccagccagcatagattgatctcgtgttacagagagggcaaggtttttggcccctgtttgcagactccatgtcttaatcagagaccacagttttctctttgttccaatctgcgccacctcggtagccccactttccttgctgtgtggacttgaaacaaaataaaatgtgttgcttc

SEQ ID NO: 122 - DNA, 2908 bp, Homo sapiens
agctaaaatataaaatgggaatataccaaatgctgatgaagatggggagcaaatagatctctcatagattgctggtggcaaggtaaaatgctctattcactctgaaaataatttagcaattactcaatctcacatgtctgcggcgtgacccctcctgcttctttaaatatcagctggggaagaggtctgagtaatacctaagagggaagtggcttcatttcagtggctgacttccagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatggtcctcctgtgtctcctgttggtgcccctcctgctcagtctctttgtactggggctatttctttggtttctgaagagagagagacaagaagagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctataaaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacatgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaaggacaaggacctccagccaggcttcatttatgcacttgtgctgcaaaagaaaagtctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaacctatgcggcccggcatggtggctcacacctgtaatcccagcactttgggaggccaaggtgggtgggtcatctgaggtcaggagttcaagaccagcctggccaacatggtgaaaccccatctctactaaagatacaaaaatttgctgagcgtggtggtgtgcacctgtaatcccagctactcgagaggccaaggcatgagaatcgcttgaacctgggaggtggaggttgcagtgagctgagatggcaccactgcactccggcctaggcaacgagagcaaaactccaatacaaacaaacaaacaaacacctgtgctaggtcagtctggcacgtaagatgaacatccctaccaatacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagattcacatacaaaaaaaaaaaaaaaa

SEQ ID NO: 123 - DNA, 4411 bp, Homo sapiens
agccaaagctataaacttcaaccggccacaagagtgtgcatgtgaggtgactgcattttttttccctgccaaaccagaattagccggtataggaatgaacgagcatgaagatttgaaattgctccgattggaaggaagcccaggttaggtttgggcacctccaaacgcacccgttttaaagccacctggactgaggcgtcgagctttcagctccaccaaacgctcacctggcctggcagcgagcggcggaagagcccgggagcccctcacagagcgcaccgagccgggcggagagctgagccgcaggcacccgcgtctccaggatgataggcgacattgcaacaaatctctacacccagcagctcagggggctccaagcagagcagcaagttcgaggatccgggcgtggagccgagtgaggccgcagcccagcgggcctcgggcgaaaaatcttggaaaatgtataccagtcatgaagatattgggtatgattttgaagatggccccaaagacaaaaagacactgaagccccacccaaacattgatggcggatgggcttggatgatggtgctctcctctttctttgtgcacatcctcatcatgggctcccagatggccctgggtgtcctcaacgtggaatggctggaagaattccaccagagccgcggcctgaccgcctgggtcagctccctcagcatgggcatcaccttgatagtgggccctttcatcggcttgttcattaacacctgtgggtgccgccagactgcgatcattggagggctcgtcaactccctgggctgggtgttgagtgcctatgctgcaaacgtgcattatctcttcattacttttggagtcgcagctggcctgggcagcgggatggcctacctgccagcggtggtcatggtgggcaggtatttccagaagagacgcgccctcgcccagggcctcagcaccacggggaccggattcggtacgttcctaatgactgtgctgctgaagtacctgtgcgcagagtacggctggaggaatgccatgttgatccaaggtgccgtttccctaaacctgtgtgtttgtggggcgctcatgaggcccctctctcctggtaaaaacccaaacgacccaggagagaaagatgtgcgtggcctgccagcgcactccacagaatctgtgaagtcaactggacagcagggaagaacagaagagaaggatggtgggctcgggaacgaggagaccctctgcgacctgcaagcccaggagtgccccgatcaggccgggcacaggaagaacatgtgtgccctccggattctgaagactgtcagctggctcaccatgagagtcaggaagggcttcgaggactggtattcgggctactttgggacagcctctctatttacaaatcgaatgtttgtagcctttattttctgggctttgtttgcatacagcagctttgtcatccccttcattcacctcccagaaatcgtcaatttgtataacttatcggagcaaaacgacgttttccctctgacgtcaattatagcaatagttcacatctttggaaaagtgatcctgggcgtcatagccgacttgccttgcattagtgtttggaatgtcttcctgttggccaacttcacccttgtcctcagtatttttattctgccgttgatgcacacgtacgctggcctggcggtcatctgtgcgctgatagggttttccagtggttatttctccctaatgcccgtagtgactgaagacttggttggcattgaacacctggccaatgcctacggcatcatcatctgtgctaatggcatctctgcattgctgggaccaccttttgcagggtggatctatgacatcacgcaaaaatatgatttttccttctacatatgtggtttgctttacatgataggaatactctttttacttattcagccgtgcattcgaattatagaacaatccagaagaaaatacatggatggtgcacatgtttagtatcatgtaatgttccgtgtaggtttcattgtaatactcatgcctacctcgcatggttgctgtgaggcacctatgacaggacgtgggaaagcattttgtacggtaactggcactgtcatttgtaaatgccattgtcacagcctcatttgtaagcagcactgcctctctgtttggggagatgtaatgctggaagatcttaaggactacatacattctagagatgacagtgttgttcaaagacagcctagtaagtaattggtagaaatgcccttataaaaaccattctcttgtcatctactgggactagggttttaaatacagcttttaaaaacaaaaacagggaataaaagcttttcaactcaaccacttctttgtaagacaaaactgaagtatctgtgtgcttccagaaagcttacagataaatgggtttcaagcacaagaatatgactagatttcagaaattaattattacagggagctattgatctactagcatcaaacaaaggcaagctctaattccacaggtaatacaatttagtgcaattaaagaaacacggcttgtatttttatgagggaattctgcagctagggattgtgactcctaaatcctcctctaaaagaaggcacttgccattaatcctaattcagtgctatccagttataaatggaatcttgagacaaaaccttaacaaagaaataacagtaatgatttccttagcagaagccgtatttgtacgcacaacattaaatcaagggctacaattcaagcacttttattcgtatcattggcctcttagatgatataagcatgaggtggggcctgtaatatttttttctgagtttcttctgcccaaaaatataatatagaactaattgctaactgacaaataaagttaatagttaaatcatctccaaggaatgttgctaatccaaagtataacactatcaatttgtgaggataataaatggaatgccattagtgtagatgtctgtgccacatctgacactggagtagtgataacaaatagcccatctctagactctcgtgttgttatatagaccattcatttgcctgagcgtggcacagttttaaaaatagttctcttgattgatttcatacagaagatgactgtgatccatgacatctaataatgccctttctttatctgagatgtctatttttctaagccaaacgtttttcagactgcagaatgttcttcccagatcatttgaaatttctggctgccttacttgtttacagatagtttaagactatttaaatttctactcacaatttgatcatcacacacacacaaatccttgaatatcattgccagtgtcttaggtcaaatttacctaaagtgaatacagcccattctcaattatccttcacaattagacgcaggaatgctactaggaattggaatcaaacaatgccaccccaagcgtaattttagccagcagtttcagttatactcaaccatgcccttctgagctgttaacaagtgattcaatggacaagttctctttttgttccatctccattatttcctgctctaatgtatagtgggagtggttgtgtaatgaaaggaccaccaaaataataaaaggcagctaatggaaaggagagacaaaagcatggttaatatatatacttaatattacctccaatgactcgggaattgcctgtaaattattatagacaatagattgcatgtcatactccatttggttcaacacaacaacctatgtgttatcattacagctttggctgctgttaaagaatccagctctctattttgataaagataatcttaaagctgaggcaatgctccctcctctatctctctctgtgtaatttaccatagaattaggatgattagattgaaacacatgttgtatgttttaaaaactacattgcttcattactttcattttccgacaacatcaaactaacaagaggcagtgttaaatattttaaatggtgctatagccaatgtatttgaatgcttgcactgctggttgtgtatcatcaatatgaactttttatccaatgactcaactctaattacatctaagttagacttgctcacgttcagtttgtacagttgtgtgttgacttactatgttttgaaagtggtgacttctaccgaatgagtggaagttcccattgtcaaaaaaaataaagacctgcttgcagtattcatgttgacaacagagtaaaagagaatactgtaaagaattactgcaaatatttcctgtttatgttatttgccgttgtttgaagatattataaagggttaattgtatatttatatcatgtgctttatcgttttcccctcatgtatccaagtaatttttatttacatacaactaaataaatgttgtcctctttgaagacggtcaaaaaaaaaaaaaa

SEQ ID NO: 124 - DNA, 1791 bp, Homo sapiens
gatccgtgcggccagggtagctatcgcggcggcggcggcggcggcggttgaactgactcggagcgaggagacccgagcgagcagacgcggccctggcgcccgccctgcgcactcaccatggcgatgcatttcatcttctcagatacagcggtgcttctgtttgatttctggagtgtccacagtcctgctggcatggccctttcggtgttggtgctcctgcttctggctgtactgtatgaaggcatcaaggttggcaaagccaagctgctcaaccaggtactggtgaacctgccaacctccatcagccagcagaccatcgcagagacagacggggactctgcaggctcagattcattccctgttggcagaacccaccacaggtggtatttgtgtcactttggccagtctctaatccatgtcatccaggtggtcatcggctacttcatcatgctggccgtaatgtcctacaacacctggattttccttggtgtggtcttgggctctgctgtgggctactacctagcttacccacttctcagcacagcttagctggtgaggaacgtgcaggcactgaggctggagggacatggagccccctcttccagacactatacttccaactgccctttcttctgatggctattcctccaccttattcccagcccctggaaactttgagctgaagccagcacttgctccctggagttcggaagccattgcagcaaccttccttctcagccagcctacgtagggcccaggcatggtcttgtgtcttaagacagctgctgtgaccaaagggagaatggagataacaggggtggcagggttactgagcccatgacaatgcttctctgtgactcaaaccaggaatttccaaagatttcaagccagggagaagggttcttggtgatgcagggcatggaacctggacaccctcagctctcctgctttgtgccttatctacaggagcatcgcccattggacttcctgacctcttctgtctttgagggacagagaccaagctagatcctttttctcacctttctgcctttggaacacatgaagatcatctcgtctatggatcatgttgacaaactaagttttttttatttttcccattgaactcctagttggcaattttgcacattcatacaaaaaaatttttaatgaaatgatttcattgattcatgatggatggcagaaactgctgagacctatttccctttcttggggagagaataagtgacagctgattaaaggcagagacacaggactgctttcaggctcctggtttattctctgatagactgagctccttccaccagaaggcactgcctgcaggaagaagatgatctgatggccgtgggtgtctgggaagctcttcgtggcctcaatgccctcctttatcctcatctttcttctatgcagaacaaaaagctgcatctaataatgttcaatacttaatattctctatttattacttactgcttactcgtaatgatctagtggggaaacatgattcattcacttaaaatactgattaagccatgggcaggtactgactgaagatgcaatccaaccaaagccattacattttttgagttagatgggactctctggatagttgaacctcttcactttataaaaaaggaaagagagaaaatcactgctgtatactaaatacctcacagattagatgaaaagatggttgtaagctttgggaattaaaaacaaacaaatacattttagtaaatatatatttttaaatagtctaaaaaaaaaaaaaaaaaa

SEQ ID NO: 125 - DNA, 2032 bp, Homo sapiens
ggactctgggacgctcagacgccgcgcggggcggggattggtctgtggtcctctctcggctcctcgcggctcgcggcggccgacggttcctgggacacctgcttgcttggcccgtccggcggctcagggcttctctgctgcgctcccggttcgctggacgggaagaagggctgggccgtcccgtcccgtccccatcggaaccccaagtcgcgccgctgacccgtcgcagggcgagatgagcgcggacgcagcggccggggcgcccctgccccggctctgctgcctggagaagggtccgaacggctacggcttccacctgcacggggagaagggcaagttgggccagtacatccggctggtggagcccggctcgccggccgagaaggcggggctgctggcgggggaccggctggtggaggtgaacggcgaaaacgtggagaaggagacccaccagcaggtggtgagccgcatccgcgccgcactcaacgccgtgcgcctgctggtggtcgaccccgagacggacgagcagctgcagaagctcggcgtccaggtccgagaggagctgctgcgcgcccaggaagcgccggggcaggccgagccgccggccgccgccgaggtgcagggggctggcaacgaaaatgagcctcgcgaggccgacaagagccacccggagcagcgcgagcttcggcctcggctctgtaccatgaagaagggccccagtggctatggcttcaacctgcacagcgacaagtccaagccaggccagttcatccggtcagtggacccagactccccggctgaggcttcagggctccgggcccaggatcgcattgtggaggtgaacggggtctgcatggaggggaagcagcatggggacgtggtgtccgccatcagggctggcggggacgagaccaagctgctggtggtggacagggaaactgacgagttcttcaagaaatgcagagtgatcccatctcaggagcacctgaatggtcccctgcctgtgcccttcaccaatggggagatacagaaggagaacagtcgtgaagccctggcagaggcagccttggagagccccaggccagccctggtgagatccgcctccagtgacaccagcgaggagctgaattcccaagacagccccccaaaacaggactccacagcgccctcgtctacctcctcctccgaccccatcctagacttcaacatctccctggccatggccaaagagagggcccaccagaaacgcagcagcaaacgggccccgcagatggactggagcaagaaaaacgaactcttcagcaacctctgagcgccctgctgccacccagtgactggcagggccgagccagcattccaccccacctttttccttctccccaattactcccctgaatcaatgtacaaatcagcacccacatcccctttcttgacaaatgatttttctagagaactatgttcttccctgactttagggaaggtgaatgtgttcccgtcctcccgcagtcagaaaggagactctgcctccctcctcctcactgagtgcctcatcctaccgggtgtccctttgccaccctgcctgggacatcgctggaacctgcaccatgccaggatcatgggaccaggcgagagggcaccctcccttcctcccccatgtgataaatgggtccagggctgatcaaagaactctgactgcagaactgccgctctcagtggacagggcatctgttaccctgagacctgtggcagacacgtcttgttttcatttgatttttgttaagagtgcagtattgcagagtctagaggaatttttgtttccttgattaacatgattttcctggttgttacatccagggcatggcagtggcctcagccttaaacttttgttcctactcccaccctcagcgaactgggcagcacggggagggtttggctacccctgcccatccctgagccaggtaccaccattgtaaggaaacactttcagaaattcagctggttcctccaaacccttcaaaaaaaaaaaaaaaaa

SEQ ID NO: 126 - DNA, 2112 bp, Homo sapiens
aaaacgggctcagttcgtaaaggagccgggtgacttcagaggcgccggcccgtccgtctgccgcacctgagcacggcccctgcccgagcctggcccgccgcgatgctgtagggaccgccgtgtcctcccgccggaccgttatccgcgccgggcgcccgccagacccgctggcaagatgccgcgctccttcctggtcaagaagcatttcaacgcctccaaaaagccaaactacagcgaactggacacacatacagtgattatttccccgtatctctatgagagttactccatgcctgtcataccacaaccagagatcctcagctcaggagcatacagccccatcactgtgtggactaccgctgctccattccacgcccagctacccaatggcctctctcctctttccggatactcctcatctttggggcgagtgagtccccctcctccatctgacacctcctccaaggaccacagtggctcagaaagccccattagtgatgaagaggaaagactacagtccaagctttcagacccccatgccattgaagctgaaaagtttcagtgcaatttatgcaataagacctattcaactttttctgggctggccaaacataagcagctgcactgcgatgcccagtctagaaaatctttcagctgtaaatactgtgacaaggaatatgtgagcctgggcgccctgaagatgcatattcggacccacacattaccttgtgtttgcaagatctgcggcaaggcgttttccagaccctggttgcttcaaggacacattagaactcacacgggggagaagcctttttcttgccctcactgcaacagagcatttgcagacaggtcaaatctgagggctcatctgcagacccattctgatgtaaagaaataccagtgcaaaaactgctccaaaaccttctccagaatgtctctcctgcacaaacatgaggaatctggctgctgtgtagcacactgagtgacgcaatcaatgtttactcgaacagaatgcatttcttcactccgaagccaaatgacaaataaagtccaaaggcattttctcctgtgctgaccaaccaaataatatgtatagacacacacacatatgcacacacacacacacacacccacagagagagagctgcaagagcatggaattcatgtgtttaaagataatcctttccatgtgaagtttaaaattactatatatttgctgatggctagattgagagaataaaagacagtaacctttctcttcaaagataaaatgaaaagcacattgcatcttttcttcctaaaaaaatgcaaagatttacattgctgccaaatcatttcaactgaaaagaacagtattgctttgtaatagagtctgtaataggatttcccataggaagagatctgccagacgcgaactcaggtgccttaaaaagtattccaagtttactccattacatgtcggttgtctggttgccattgttgaactaaagcctttttttgattacctgtagtgctttaaagtatatttttaaaagggaggaaaaaaataacaagaacaaaacacaggagaatgtattaaaagtatttttgttttgttttgtttttgccaattaacagtatgtgccttgggggaggagggaaagattagctttgaacattcctggcgcatgctccattgtcttactattttaaaacattttaataatttttgaaaattaattaaagatgggaataagtgcaaaagaggattcttacaaattcattaatgtacttaaactatttcaaatgcataccacaaatgcaataatacaataccccttccaagtgcctttttaaattgtatagttgatgagtcaatgtaaatttgtgtttatttttatatgattgaatgagttctgtatgaaactgagatgttgtctatagctatgtctataaacaacctgaagacttgtgaaatcaatgtttcttttttaaaaaacaattttcaagttttttttacaataaacagttttgatttaaaatctcgtttgtatactattttcagagactttacttgcttcatgattagtaccaaaccactgtacaaagaattgtttgttaacaagaaaaaaa

SEQ ID NO: 127 - DNA, 3604 bp, Homo sapiens
gggagaaggaggaggccgggggaaggaggagacaggaggaggagggaccacggggtggaggggagatagacccagcccagagctctgagtggtttcctgttgcctgtctctaaacccctccacattcccgcggtccttcagactgcccggagagcgcgctctgcctgccgcctgcctgcctgccactgagggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtaggagaatttgatgatggtgcagaggaaaccgaagaggaggtggtggcggaaaatccctgccagaaccaccactgcaaacacggcaaggtgtgcgagctggatgagaacaacacccccatgtgcgtgtgccaggaccccaccagctgcccagcccccattggcgagtttgagaaggtgtgcagcaatgacaacaagaccttcgactcttcctgccacttctttgccacaaagtgcaccctggagggcaccaagaagggccacaagctccacctggactacatcgggccttgcaaatacatccccccttgcctggactctgagctgaccgaattccccctgcgcatgcgggactggctcaagaacgtcctggtcaccctgtatgagagggatgaggacaacaaccttctgactgagaagcagaagctgcgggtgaagaagatccatgagaatgagaagcgcctggaggcaggagaccaccccgtggagctgctggcccgggacttcgagaagaactataacatgtacatcttccctgtacactggcagttcggccagctggaccagcaccccattgacgggtacctctcccacaccgagctggctccactgcgtgctcccctcatccccatggagcattgcaccacccgctttttcgagacctgtgacctggacaatgacaagtacatcgccctggatgagtgggccggctgcttcggcatcaagcagaaggatatcgacaaggatcttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttagaaactgccttcctgggtgatttgcatgtgtcttagtcttagtcaccttattatcctgacacaaaaacacatgagcatacatgtctacacatgactacacaaatgcaaacctttgcaaacacattatgcttttgcacacacacacctgtacacacacaccggcatgtttatacacagggagtgtatggttcctgtaagcactaagttagctgttttcatttaatgacctgtggtttaacccttttgatcactaccaccattatcagcaccagactgagcagctatatccttttattaatcatggtcattcattcattcattcattcacaaaatatttatgatgtatttactctgcaccaggtcccatgccaagcactggggacacagttatggcaaagtagacaaagcatttgttcatttggagcttagagtccaggaggaatacattagataatgacacaatcaaatataaattgcaagatgtcacaggtgtgatgaagggagagtaggagagaccatgagtatgtgtaacaggaggacacagcattattctagtgctgtactgttccgtacggcagccactacccacatgtaactttttaagatttaaatttaaattagttaacattcaaaacgcagctccccaatcacactagcaacatttcaagtgcttgagagccatgcatgattagtggttaccctattgaataggtcagaagtagaatcttttcatcatcacagaaagttctattggacagtgctcttctagatcatcataagactacagagcacttttcaaagctcatgcatgttcatcatgttagtgtcgtattttgagctggggttttgagactccccttagagatagagaaacagacccaagaaatgtgctcaattgcaatgggccacatacctagatctccagatgtcatttcccctctcttattttaagttatgttaagattactaaaacaataaaagctcctaaaaaatcaaactgtattctggtgttctcttctacacagtgggagggcgagcagtaggagagattggcccatttggtgctggccatttgaggaatgcaagcccagcactagtctcataatctctaggaatctgtagagagaggaattgaagtaaatttcagcattggctcattcagtcattcggcgacattcatcaggtacctgcaatgtgttaggggatcttatgagtaggcagcgtgcgtgatccttgctcccctggagctttctaacattctagcaggcagaccacacataaatttgcaatactgtttctgataaaaacgtgctgtaaaggaaataaagcagagaactatcatggaaaaaaaaaaaaaaaaaa

SEQ ID NO: 128 - DNA, 3745 bp, Homo sapiens
ccgagttcagtcatactgcaccagctgagcaatgcatggagtggacctgtaggcgacttgcatcgtcttcaacatgaagatagccacagtgtcagtgcttctgcccttggctctttgcctcatacaagatgctgccagtaagaatgaagatcaggaaatgtgccatgaatttcaggcatttatgaaaaatggaaaactgttctgtccccaggataagaaattttttcaaagtcttgatggaataatgttcatcaataaatgtgccacgtgcaaaatgatactggaaaaagaagcaaaatcacagaagagggccaggcatttagcaagagctcccaaggctactgccccaacagagctgaattgtgatgattttaaaaaaggagaaagagatggggattttatctgtcctgattattatgaagctgtttgtggcacagatgggaaaacatatgacaacagatgtgcactgtgtgctgagaatgcgaaaaccgggtcccaaattggtgtaaaaagtgaaggggaatgtaagagcagtaatccagagcaggatgtatgcagtgcttttcggccctttgttagagatggaagacttggatgcacaagggaaaatgatcctgttcttggtcctgatgggaagacgcatggcaataagtgtgcaatgtgtgctgagctgtttttaaaagaagctgaaaatgccaagcgagagggtgaaactagaattcgacgaaatgctgaaaaggatttttgcaaggaatatgaaaaacaagtgagaaatggaaggcttttttgtacacgggagagtgatccagtccgtggccctgacggcaggatgcatggcaacaaatgtgccctgtgtgctgaaattttcaagcagcgtttttcagaggaaaacagtaaaacagatcaaaatttgggaaaagctgaagaaaaaactaaagttaaaagagaaattgtgaaactctgcagtcaatatcaaaatcaggcaaagaatggaatacttttctgtaccagagaaaatgaccctattcgtggtccagatgggaaaatgcatggcaacttgtgttccatgtgtcaagcctacttccaagcagaaaatgaagaaaagaaaaaggctgaagcacgagctagaaacaaaagagaatctggaaaagcaacctcatatgcagagctttgcagtgaatatcgaaagcttgtgaggaacggaaaacttgcttgcaccagagagaacgatcctatccagggcccagatgggaaagtgcatggcaacacctgctccatgtgtgaggtcttcttccaagcagaagaagaagaaaagaaaaagaaggaaggtaaatcaagaaacaaaagacaatctaagagtacagcttcctttgaggagttgtgtagtgaataccgcaaatccaggaaaaacggacggcttttttgcaccagagagaatgaccccatccagggcccagatggaaaaatgcatggcaacacctgctccatgtgtgaggccttctttcaacaagaagaaagagcaagagcaaaggctaaaagagaagctgcaaaggaaatctgcagtgaatttcgggaccaagtgaggaatggaacacttatatgcaccagggagcataatcctgtccgtggcccagatggcaaaatgcatggaaacaagtgtgccatgtgtgccagtgtgttcaaacttgaagaagaagagaagaaaaatgataaagaagaaaaagggaaagtcgaggctgaaaaagttaagagagaagcagttcaggagctgtgcagtgaatatcgtcattatgtgaggaatggacgactcccctgtaccagagagaatgatcctattgagggtctagatgggaaaatccacggcaacacctgctccatgtgtgaagccttcttccagcaagaagcaaaagaaaaagaaagagctgaacccagagcaaaagtcaaaagagaagctgaaaaggagacatgcgatgaatttcggagacttttgcaaaatggaaaacttttctgcacaagagaaaatgatcctgtgcgtggcccagatggcaagacccatggcaacaagtgtgccatgtgtaaggcagtcttccagaaagaaaatgaggaaagaaagaggaaagaagaggaagatcagagaaatgctgcaggacatggttccagtggtggtggaggaggaaacactcaggacgaatgtgctgagtatcgggaacaaatgaaaaatggaagactcagctgtactcgggagagtgatcctgtacgtgatgctgatggcaaatcgtacaacaatcagtgtaccatgtgtaaagcaaaattggaaagagaagcagagagaaaaaatgagtattctcgctccagatcaaatgggactggatcagaatcagggaaggatacatgtgatgagtttagaagccaaatgaaaaatggaaaactcatctgcactcgagaaagtgaccctgtccggggtccagatggcaagacacatggcaataagtgtactatgtgtaaggaaaaactggaaagggaagcagctgaaaaaaaaaagaaagaggatgaagacaggagcaatacaggagaaaggagcaatacaggagaaaggagcaatgacaaagaggatctgtgtcgtgaatttcgaagcatgcagagaaatggaaagcttatctgcaccagagaaaataaccctgttcgaggcccatatggcaagatgcacatcaataaatgtgctatgtgtcagagcatctttgatcgagaagctaatgaaagaaaaaagaaagatgaagagaaatcaagtagcaagccctcaaataatgcaaaggaccagtgcagacaggttcagaatgaagcggaggatgcaaaatttagacaacctgggcgttccttggcctctgttgccaggatgagtacagatgagtgcagtgaatttcgaaactatataaggaacaatgaactcatctgccctagagagaatgacccagtgcacggtgctgatggaaagttctatacaaacaagtgctacatgtgcagagctgtctttctaacagaagctttggaaagggcaaagcttcaagaaaagccatcccatgttagagcttctcaagaggaagacagcccagactctttcagttctctggattctgagatgtgcaaagactaccgagtattgcccaggataggttatctttgtccaaaggatttaaagcctgtctgtggtgacgatggccaaacctacaacaatccttgcatgctctgtcatgaaaacctgatacgccaaacaaatacacacatccgcagtacagggaagtgtgaggagagcagcaccccaggaaccaccgcagccagcatgcccccgtctgacgaatgacaggaagattgttgaaagccatgagggaaaaaataaaccccagttctgaatcacctaccttcaccatctgtatatacaaagaattcttcggagcttgtcttatttgctatagaaaacaatacagagcttttgggaatggactcactgattttcagtcttttccatctctttcctcctagactctgtgatctgagggtataaagacatctccaccaagtctgagccctcaaaatgtcctgattacaatgctgtctgtccaactgcctgttcaataaaagtaaactcagcagaacaccctttctgggatttctttgtcactatctggataatagatatttgcttttaaagaaactgaataaactctaccctttaaaaaaaaaaaaaaaa

SEQ ID NO: 129 - DNA, 1574 bp, Homo sapiens
tcaccacggcggcagccctttaaacccctcacccagccagcgccccatcctgtctgtccgaacccagacacaagtcttcactccttcctgcgagccctgaggaagccttgtgagtgcattggctggggcttggagggaagttgggctggagctggacaggagcagtgggtgcatttcaggcaggctctcctgaggtcccaggcgccagctccagctccctggctagggaaacccaccctctcagtcagcatgggggcccaagctccaggcagggtgggctggatcactagcgtcctggatctctctcagactgggcagccccgggctcattgaaatgccccggatgacttggctagtgcagaggaattgatggaaaccaccggggtgagagggaggctccccatctcagccagccacatccacaaggtgtgtgtaagggtgcaggcgccggccggttaggccaaggctctactgtctgttgcccctccaggagaacttccaaggagctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtgattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggcaaagacatggcagcagtgcagaggaccctgatggctttgggcagcttggcagtgaccaagaatgatgggcactaccgtggagatcccaactggtttatgaagaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggccctcccccagctccttggctgcagccatcccgcttagcctgcctcacccacacccgtgtggtaccttcagccctggccaagctttgaggctctgtcactgagcaatggtaactgcacctgggcagctcctccctgtgcccccagcctcagcccaacttcttacccgaaagcatcactgccttggcccctccctcccggctgcccccatcacctctactgtctcctccctgggctaagcaggggagaagcgggctgggggtagcctggatgtgggccaagtccactgtcctccttggcggcaaaagcccattgaagaagaaccagcccagcctgccccctatcttgtcctggaatatttttggggttggaactcaaaaaaaaaaaaaaaaaatcaatcttttctcaaaaaaaaaaaaaaaaaa

SEQ ID NO: 130 - DNA, 2619 bp, Homo sapiens
cccacccgtcccagctcggcttagcccccgcggacccctccaggccgcgaccccagggcgtcctgtgccgccacgccctccatctgtgtgggtcctctgctgggcccgcccctggtcacagccagactgactcagtttccctgggaggtcccgctcgagcccgtccttcccctccctctgcccgcccccagccctcgccccaccctcggcgcccgcacatctgcctgctcagctccagacggcgcccggacccccgggcgcgggatccagccaggtgggagccccgcagatgaggtctctgaaggtgtgcctgaaccagtgccagcctgccctgtctgcagcatcggcctgatggggtggtgactgatccctcagggctccggagccatgtggcccaacggcagttccctggggccctgtttccggcccacaaacattaccctggaggagagacggctgatcgcctcgccctggttcgccgcctccttctgcgtggtgggcctggcctccaacctgctggccctgagcgtgctggcgggcgcgcggcaggggggttcgcacacgcgctcctccttcctcaccttcctctgcggcctcgtcctcaccgacttcctggggctgctggtgaccggtaccatcgtggtgtcccagcacgccgcgctcttcgagtggcacgccgtggaccctggctgccgtctctgtcgcttcatgggcgtcgtcatgatcttcttcggcctgtccccgctgctgctgggggccgccatggcctcagagcgctacctgggtatcacccggcccttctcgcgcccggcggtcgcctcgcagcgccgcgcctgggccaccgtggggctggtgtgggcggccgcgctggcgctgggcctgctgcccctgctgggcgtgggtcgctacaccgtgcaatacccggggtcctggtgcttcctgacgctgggcgccgagtccggggacgtggccttcgggctgctcttctccatgctgggcggcctctcggtcgggctgtccttcctgctgaacacggtcagcgtggccaccctgtgccacgtctaccacgggcaggaggcggcccagcagcgtccccgggactccgaggtggagatgatggctcagctcctggggatcatggtggtggccagcgtgtgttggctgccccttctggtcttcatcgcccagacagtgctgcgaaacccgcctgccatgagccccgccgggcagctgtcccgcaccacggagaaggagctgctcatctacttgcgcgtggccacctggaaccagatcctggacccctgggtgtatatcctgttccgccgcgccgtgctccggcgtctccagcctcgcctcagcacccggcccaggtcgctgtccctccagccccagctcacgcagcgctccgggctgcagtaggaagtggacagagcgcccctcccgcgcctttccgcggagcccttggcccctcggacagcccatctgcctgttctgaggattcaggggctgggggtgctggatggacagtgggcatcagcagcagggttttgggttgaccccaatccaacccggggacccccaactcctccctgatccttttaccaagcactctcccttcctcggcccctttttcccatccagagctcccaccccttctctgcgtccctcccaaccccaggaagggcatgcagacattggaagagggtcttgcattgctatttttttttttagacggagtcttgctctgtcccccaggctggagtgcagtggcgcaatctcagctcactgcaacctccacctcccgggttcaagcgattctcctgcctcagcctcctgagtagctgggactataggcgcgcgccaccacgcccggctaatttttgtatttttagtagagacggggtttcaccgtgttggccaggctggtcttgaactcctgacctcaggtgattcaccagcctcagcctcccaaagtgctgggatcacaggcatgaaccaccacacctggccatttttttttttttttttagacggagtctcactctgtggcccagcctggagtacagtggcacgatctcggctcactgcaacctccgcctcccgggttcaagcgattctcgtgcctcagcctcccgagcagctgggattacaggcgtaagccactgcgcccggccttgcatgctctttgaccctgaatttgacctacttgctggggtacagttgcttccttttgaacctccaacagggaaggctctgtccagaaaggattgaatgtgaacgggggcacccccttttcttgccaaaatatatctctgcctttggttttattttcctttgggtccagaagttttcaatctctggagtttgtgcattgggcctcacccggagcagacgagggcagggctgggaaggatggggagggacatagaggattcggttcctcccccaccttgtttcttgagtgtttcctaatcacttgatgggtggtaccacctagaattcttccagcagcctgtaatgggagggctacaggttagccctggaacctgcaatcaaaccacctttgaatctgtgtgtcattaaaagtagatataaatgggcaaaaaaaaaaaaaaaaaa

SEQ ID NO: 131 - DNA, 3510 bp, Homo sapiens
aaaatttcagcagagagaaatagagaaagcagtgtgtgtgcatgtgtgtgtgtgtgagagagagagggagaggagcgagagggagagggagagggagagagagaaagggagggaagcagagagtcaagtccaagggaatgagcgagagaggcagagacaggggaagaggcgtgcgagagaaggaataacagctttccggagcaggcgtgccgtgaactggcttctattttattttatttttttctcctttttattttttaaagagaagcaggggacagaagcaatggccgaggcagaagacaagccgaggtgctggtgaccctgggcgtctgagtggatgattggggctgctgcgctcagaggcctgcctccctgccttccaatgcatataaccccacaccccagccaatgaagacgagaggcagcgtgaacaaagtcatttagaaagcccccgaggaagtgtaaacaaaagagaaagcatgaatggagtgcctgagagacaagtgtgtcctgtactgcccccacctttagctgggccagcaactgcccggccctgcttctccccacctactcactggtgatctttttttttttacttttttttcccttttcttttccattctcttttcttattttctttcaaggcaaggcaaggattttgattttgggacccagccatggtccttctgcttcttctttaaaatacccactttctccccatcgccaagcggcgtttggcaatatcagatatccactctatttatttttacctaaggaaaaactccagctcccttcccactcccagctgccttgccacccctcccagccctctgcttgccctccacctggcctgctgggagtcagagcccagcaaaacctgtttagacacatggacaagaatcccagcgctacaaggcacacagtccgcttcttcgtcctcagggttgccagcgcttcctggaagtcctgaagctctcgcagtgcagtgagttcatgcaccttcttgccaagcctcagtctttgggatctggggaggccgcctggttttcctccctccttctgcacgtctgctggggtctcttcctctccaggccttgccgtccccctggcctctcttcccagctcacacatgaagatgcacttgcaaagggctctggtggtcctggccctgctgaactttgccacggtcagcctctctctgtccacttgcaccaccttggacttcggccacatcaagaagaagagggtggaagccattaggggacagatcttgagcaagctcaggctcaccagcccccctgagccaacggtgatgacccacgtcccctatcaggtcctggccctttacaacagcacccgggagctgctggaggagatgcatggggagagggaggaaggctgcacccaggaaaacaccgagtcggaatactatgccaaagaaatccataaattcgacatgatccaggggctggcggagcacaacgaactggctgtctgccctaaaggaattacctccaaggttttccgcttcaatgtgtcctcagtggagaaaaatagaaccaacctattccgagcagaattccgggtcttgcgggtgcccaaccccagctctaagcggaatgagcagaggatcgagctcttccagatccttcggccagatgagcacattgccaaacagcgctatatcggtggcaagaatctgcccacacggggcactgccgagtggctgtcctttgatgtcactgacactgtgcgtgagtggctgttgagaagagagtccaacttaggtctagaaatcagcattcactgtccatgtcacacctttcagcccaatggagatatcctggaaaacattcacgaggtgatggaaatcaaattcaaaggcgtggacaatgaggatgaccatggccgtggagatctggggcgcctcaagaagcagaaggatcaccacaaccctcatctaatcctcatgatgattcccccacaccggctcgacaacccgggccaggggggtcagaggaagaagcgggctttggacaccaattactgcttccgcaacttggaggagaactgctgtgtgcgccccctctacattgacttccgacaggatctgggctggaagtgggtccatgaacctaagggctactatgccaacttctgctcaggcccttgcccatacctccgcagtgcagacacaacccacagcacggtgctgggactgtacaacactctgaaccctgaagcatctgcctcgccttgctgcgtgccccaggacctggagcccctgaccatcctgtactatgttgggaggacccccaaagtggagcagctctccaacatggtggtgaagtcttgtaaatgtagctgagaccccacgtgcgacagagagaggggagagagaaccaccactgcctgactgcccgctcctcgggaaacacacaagcaacaaacctcactgagaggcctggagcccacaaccttcggctccgggcaaatggctgagatggaggtttccttttggaacatttctttcttgctggctctgagaatcacggtggtaaagaaagtgtgggtttggttagaggaaggctgaactcttcagaacacacagactttctgtgacgcagacagaggggatggggatagaggaaagggatggtaagttgagatgttgtgtggcaatgggatttgggctaccctaaagggagaaggaagggcagagaatggctgggtcagggccagactggaagacacttcagatctgaggttggatttgctcattgctgtaccacatctgctctagggaatctggattatgttatacaaggcaagcattttttttttttttttaaagacaggttacgaagacaaagtcccagaattgtatctcatactgtctgggattaagggcaaatctattacttttgcaaactgtcctctacatcaattaacatcgtgggtcactacagggagaaaatccaggtcatgcagttcctggcccatcaactgtattgggccttttggatatgctgaacgcagaagaaagggtggaaatcaaccctctcctgtctgccctctgggtccctcctctcacctctccctcgatcatatttccccttggacacttggttagacgccttccaggtcaggatgcacatttctggattgtggttccatgcagccttggggcattatgggttcttcccccacttcccctccaagaccctgtgttcatttggtgttcctggaagcaggtgctacaacatgtgaggcattcggggaagctgcacatgtgccacacagtgacttggccccagacgcatagactgaggtataaagacaagtatgaatattactctcaaaatctttgtataaataaatatttttggggcatcctggatgatttcatcttctggaatattgtttctagaacagtaaaagccttattctaaggtgtatgtctgactcgataaatatccttcaattacccttaaaaaaaaaaaaaaaaaa

SEQ ID NO: 132 - DNA, 2805 bp, Homo sapiens
ctccttgcacgggccggcccagcttccccgcccctggcgtccgctccctcccgctcgcagcttacttaacctggcccgggcggcggaggcgctctcacttccctggagccgcccgcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtagagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtctttgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacata

SEQ ID NO: 133 - DNA, 3140 bp, Homo sapiens
ctggcccgcccctcaccctggtccgtctccctgtgtctgtggtcgtcagttccactggcaggggacctgcctccctgttgccaccacaagagaggaaaagttggtcaaacaggtggggaggccagagctacaagcctcgggttccctccccaccacccgtgccaggcaggcacccgggccctggcacctgctgcctgcccagaggccacccagcctcctagacaggtggctgacatggaggagctgaccatctgggaacagcacacggccacactgtccaaggacccccgccggggctttggcattgcgatctctggaggccgagaccggcccggtggatccatggttgtatctgacgtggtacctggagggccggcggagggcaggctacagacaggcgaccacatcgtcatggtgaacggggtttccatggagaatgccacctccgcgtttgccattcagatactcaagacctgcaccaagatggccaacatcacagtgaaacgtccccggaggatccacctgcccgccaccaaagccagcccctccagcccagggcgccaggactcggatgaagacgatgggccccagcgggtggaggaggtggaccagggccggggctatgacggcgactcatccagtggctccggccgctcctgggacgagcgctcccgccggccgaggcctggtcgccggggccgggccggcagccatgggcgtaggagcccaggtggtggctctgaggccaacgggctggccctggtgtccggctttaagcggctgccacggcaggacgtgcagatgaagcctgtgaagtcagtgctggtgaagaggagagacagcgaagagtttggcgtcaagctgggcagtcagatcttcatcaagcacattacagattcgggcctggctgcccggcaccgtgggctgcaggaaggagatctcattctacagatcaacggggtgtctagccagaacctgtcactgaacgacacccggcgactgattgagaagtcagaagggaagctaagcctgctggtgctgagagatcgtgggcagttcctggtgaacattccgcctgctgtcagtgacagcgacagctcgccattggaggacatctcggacctcgcctcggagctatcgcaggcaccaccatcccacatcccaccaccaccccggcatgctcagcggagccccgaggccagccagaccgactctcccgtggagagtccccggcttcggcgggaaagttcagtagattccagaaccatctcggaaccagatgagcaacggtcagagttgcccagggaaagcagctatgacatctacagagtgcccagcagtcagagcatggaggatcgtgggtacagccccgacacgcgtgtggtccgcttcctcaagggcaagagcatcgggctgcggctggcagggggcaatgacgtgggcatcttcgtgtccggggtgcaggcgggcagcccggccgacgggcagggcatccaggagggagatcagattctgcaggtgaatgacgtgccattccagaacctgacacgggaggaggcagtgcagttcctgctggggctgccaccaggcgaggagatggagctggtgacgcagaggaagcaggacattttctggaaaatggtgcagtcccgcgtgggtgactccttctacatccgcactcactttgagctggagcccagtccaccgtctggcctgggcttcacccgtggcgacgtcttccacgtgctggacacgctgcaccccggccccgggcagagccacgcacgaggaggccactggctggcggtgcgcatgggtcgtgacctgcgggagcaagagcggggcatcattcccaaccagagcagggcggagcagctggccagcctggaagctgcccagagggccgtgggagtcgggcccggctcctccgcgggctccaatgctcgggccgagttctggcggctgcggggtcttcgtcgaggagccaagaagaccactcagcggagccgtgaggacctctcagctctgacccgacagggccgctacccgccctacgaacgagtggtgttgcgagaagccagtttcaagcgcccggtagtgatcctgggacccgtggccgacattgctatgcagaagttgactgctgagatgcctgaccagtttgaaatcgcagagactgtgtccaggaccgacagcccctccaagatcatcaaactagacaccgtgcgggtgattgcagaaaaagacaagcatgcgctcctggatgtgaccccctccgccatcgagcgcctcaactatgtgcagtactaccccattgtggtcttcttcatccccgagagccggccggccctcaaggcactgcgccagtggctggcgcctgcctcccgccgcagcacccgtcgcctctacgcacaagcccagaagctgcgaaaacacagcagccacctcttcacagccaccatccctctgaatggcacgagtgacacctggtaccaggagctcaaggccatcattcgagagcagcagacgcggcccatctggacggcggaagatcagctggatggctccttggaggacaacctagacctccctcaccacggcctggccgacagctccgctgacctcagctgcgacagccgcgttaacagcgactacgagacggacggcgagggcggcgcgtacacggatggcgagggctacacagacggcgagggggggccctacacggatgtggatgatgagcccccggctccagccctggcccggtcctcggagcccgtgcaggcagatgagtcccagagcccgagggatcgtgggagaatctcggctcatcagggggcccaggtggacagccgccacccccagggacagtggcgacaggacagcatgcgaacctatgaacgggaagccctgaagaaaaagtttatgcgagtacatgatgcggagtcctccgatgaagacggctatgactggggtccggccactgacctgtgacctctcgaaggctgccagctggtccgtcctccttctccctccctggggctgggactcagtttcccatacagaacccacaaccttacctccctccgcctggtctttaataaacagagtattttcacagcaaaaaaaaaaaaaaaaaa

SEQ ID NO: 134 - DNA, 2031 bp, Homo sapiens
cagctgcctatcggcttctcagtgtttgaacttcaaagggctggacgctcacccaagaaggggaccccggcctgacctctctcggaattcaaaaaaatctaaggctcagagagggaatgggagctggctcttccctctgtgtttagcatccacgttttttggcggtctggctgaaaccagcccaccctagttcgggcgccagagcaacgcagttccgagggcagatctccaaggggcggaggcagagccgcgggtggatctttaactcaagactagcatgaagagttgccttctggcctgccctgagtctcctcaaataacaacaggcccttccaccgcagccatccgcacgggaggcctcgcgattgctcggaaccatcccgcaggagttcagctgatattttctagtgtggggcgagagattttgtggagcgcatttaaggggtttttgttgtgactgctgccttgtatatatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacagccaggaggaagaagaggaggatgaggaggctgcctcaaggtactatgttcccagctacgaggaagtgatgaacacaaactactcagaagcaaggggagaggagcagaacccgaggttgagcatctctctcccgtcctatgagtcactgacggggctcgacgagaccacccccacatccaccagggctgacgtggaggccagccctgggaacccccctgacaggcagaactctaagttggccaaacgactgaaaccgctgaaagttcgaaggattaaatctgaaaagcttcacctcaaagactttaggatcaacctcccagacaaaaacgtccctcctccctcgatagagcctttgactcctccaccgcagtatgatgaagtccaggagaaggcccccgacacccggccgcccgactgaatggccccacttgagccacgctccctcctgtctctcacacctttcacccccaagactctaacaaagccacatgagccacagttgagaagcggaggggccagctgtgcatggagccatttggatggcggcgggcggggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggcggctctcgcagagcccctgatgctgttgttctttgagggcttaaggcctgatgaacgtaggcacgtgatgcataatagtcttcaatggtacacttaactagtctcttctgtgtaacagcaaaaaaaaaaaaaaaaagaagaagaaagaaaactgtaggaaatgttctttttgaaatgccatgcaatggagctttttgtaataaaatattttatatgtagtaaaaaaaaaaaaaaaa

SEQ ID NO: 135 - DNA, 2428 bp, Homo sapiens
aatttgtttccttatttctttgagccgtagacttctaatacatctagagatgtcatatagttgattagaaagttgagttcagtgggtgcagacctgcaagatcatattcttcctcctgtacatgatgtatcggacagtgggatttggcacccgaagcagaaatctgaagccatggatgattgccgttctcattgtgttgtccctgacagtggtggcagtgaccataggtctcctggttcacttcctagtatttgaccaaaaaaaggagtactatcatggctcctttaaaattttagatccacaaatcaataacaatttcggacaaagcaacacatatcaacttaaggacttacgagagacgaccgaaaatttggtgagtcaggtggatgagatatttatagattcagcctggaagaaaaattatatcaagaaccaagtagtcagactgactccagaggaagatggtgtgaaagtagatgtcattatggtgttccagttcccctctactgaacaaagggcagtaagagagaagaaaatccaaagcatcttaaatcagaagataaggaatttaagagccttgccaataaatgcctcatcagttcaagttaatgcaatgagctcatcaacaggggagttaactgtccaagcaagttgtggtaaacgagttgttccattaaacgtcaacagaatagcatctggagtcattgcacccaaggcggcctggccttggcaagcttcccttcagtatgataacatccatcagtgtggggccaccttgattagtaacacatggcttgtcactgcagcacactgcttccagaagtataaaaatccacatcaatggactgttagttttggaacaaaaatcaaccctcccttaatgaaaagaaatgtcagaagatttattatccatgagaagtaccgctctgcagcaagagagtacgacattgctgttgtgcaggtctcttccagagtcaccttttcggatgacatacgccagatttgtttgccagaagcctctgcatccttccaaccaaatttgactgtccacatcacaggatttggagcactttactatggtggggaatcccaaaatgatctccgagaagccagagtgaaaatcataagtgatgatgtctgcaagcaaccacaggtgtatggcaatgatataaaacctggaatgttctgtgccggatatatggaaggaatttatgatgcctgcaggggtgattctgggggacctttagtcacaagggatctgaaagatacgtggtatctcattggaattgtaagctggggagataactgtggtcaaaaggacaagcctggagtctacacacaagtgacttattaccgaaactggattgcttcaaaaacaggcatctaattcacgataaaagttaaacaaagaaagctgtatgcaggtcatatatgcatgagaattcaactatttagtgggtgtagtacaacaaagtgatattaaattactggatctagtaacatgaaacacacaacgtaagttatttagaatcactttaatcaaccaataatccttagccaatttataagggacttttatttgtaaagtaatggatctggcttgaaaaatacggtagagatacttagctctttaaatcacgaatgttgaagtaccagtgagactcaatacatatttttgaagatagtccatgggatttttagaatgtcgttgtcaagggtctccttttaactgagaaactttttgaactcacaaagtgttcaagaaacccttgtataattccctacatttctctcgagctcacaaatacttttttttctttttccttattcaatcagattttccaaagtacctttccaccataagaaatgaattttctacttctacacccatttgagagacaccaataaaagaaagtcatatgtaggaaacaaagtctgatagtaaaacaagccagagatcttctaactttttttagttataaaacctctaatttttggtgacttttctacacacacacacacatacagtcacatagatattcttatcctacagatataatcagaaaaatcccgattaatgaattatatatagatagatagagtgattagttaatcaaaactatatatttgttaaaaatttgggagaaggtgatggtaatttcattagtcccaaaacaccggcataagaaatttgacatttcacagatgcacttacatattttgaccacaagggggaaattttgtgcattattattgtagggttaaatgcctgaaaaaaataagcatttactaataccttgaaaaatcaaagaacattatgttcctccgtagcaagaaaaattttatgccctcgcattgctacagccaaatagcttataaggcttatggcaatgtcccaactattgcaatcataaaaccctagttttag

SEQ ID NO: 136 - DNA, 2645 bp, Homo sapiens
agcacataagtcaaaagctgcgtcagaaggttctaacttttgtcatcactattaccagcattgtcatcgttatcgttatcttcgtcatcatcattaccaccgttatacctgatactgccataacaatcagaacattatgtacaggcacggcatatcttcccaaagatcttggccactatggactacgatctttatttttcttggagtggcggcaatcttgggagtaaccattggtcttcttgttcattttctggcagttgagaagacttactattatcaaggtgattttcatatttctggagtcacatacaatgataattgtgaaaacgcagcttcacaagccagcacaaatctaagcaaagatattgagactaagatgttaaatgcatttcaaaattccagtatatataaggaatatgtcaaatctgaggtcatcaaacttctgcctaatgccaatggttcaaatgtgcagttacagctgaaattcaagtttcctccagcagaaggagttagcatgaggactaaaatcaaggctaaattacatcagatgttgaaaaacaacatggcatcctggaatgcagttcctgcttccattaaactcatggaaatcagcaaggctgcttctgaaatgcttaccaacaactgttgtgggagacaagtagccaacagtatcataactggcaacaaaattgtgaatggaaaaagctccctggagggggcatggccatggcaggccagcatgcaatggaaaggccgtcactactgtggagcctctctgatcagcagcaggtggctattatctgcagctcactgctttgctaagaaaaataattcaaaagattggactgtcaactttggaattgtagtaaataaaccatatatgacacggaaagtccaaaacattatttttcatgaaaattatagcagtcctgggcttcatgatgatattgcccttgtgcagcttgctgaagaagtttcttttacagagtacattcgtaagatttgtcttcctgaagccaaaatgaagctctcagaaaatgacaatgttgtagttacaggttggggaacactttatatgaatggttcatttccagtgatacttcaagaagactttttgaagattattgacaacaaaatttgcaatgcctcatatgcatactctggctttgtgactgatacaatgttatgtgctggatttatgtcaggagaagctgatgcatgtcagaatgattctggtggaccactagcttaccctgattccagaaatatctggcatcttgttggaatagtaagctggggtgatggatgtggtaaaaagaataagccaggtgtctatactcgagtgacttcttatcgcaattggattacatccaagactggactctgaaaaaaaaggaattatacaaaggaacataaagaccactgtaggctatccttatctgtggctttgggatctttttattttgattgttggtaaactaatcattttattatatataaaaatataaatgtctttattaatattttattatatctaaaacactgtccatgcatttattaatcttttaaattaatgtaagagataggaagaggccaggtgtagtggctcatgcctgtaatcctagcactttgagaggccgagataggcggattgcttgagcccaggagtttgagggcagcctgggaaacatggctaaatccgtgttcaaaaaatacaaaaattagctaggcatggtggcgtgcacctatagtcccagctattcaggaggctgaggtgggaggattgcttgagcccagcaggttgaggctgtggtgatttgtgattgcgccaccactgcactccagcctgggcaacagagtgagaccctgtctcaaaaaaaaaaaaaaaaaaaggagagaagaaaataaagaaggctaatatataatttttcttaatagctgagttgtgattcattttaccattatattcagaattgaccttaatttgttttccagaatcaaaagaaaataaaatataaattttgaaactatgagaacatatataggggatttatcaaatgagttactttttattatatcaattataatttcattttattaactggaataagtgcgaaagtgtacattactttttaacttatatgtgaaatgattcatgtacctcacaaaatcatgcaatcttgcagtgaagaaggagtatcagagctccagctacactgagtctttcaatttacagatcaagaaactgaagaccagagaagagaaatgatttggttaaagtcactctccatcatctgtgataagttgacaaatttatccttacacaaatttgtcctcattgagttgacatccaaaatttgtcaggaattaaagaatgacttttgagtggcaattatttatataacattttccattgtcttcatattcaccttttgtcatttgtttgctttctcttgcagcaaaaataatatgaggtcatcaagggcagagaactgtgtggcatctccttatagtaaaagtgcaatcatatggatggctaactttgtaatctctacaaataatttaccttatgtaattttccaaatgtaaaagtcaccaaaaacttaaaggcattaaaataaactaaaaaagtactcatttcttca

SEQ ID NO: 137 - DNA, 3250 bp, Homo sapiens
accagggtcccggctcggggtccgggctggggaggggaacctgggcgcctgggacccgccgatgccccctgccccgcccggaggtgaaagcgggtgtgaggagcgcggcgcggcaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaaggggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctggggccacttggtagtgtccccagcctacctctccacaaggggattttgctgatgggttcttagagccttagcagccctggatggtggccagaaataaagggaccagcccttcatgggtggtgacgtggtagtcacttgtaaggggaacagaaacatttttgttcttatggggtgagaatatagacagtgcccttggtgcgagggaagcaattgaaaaggaacttgccctgagcactcctggtgcaggtctccacctgcacattgggtggggctcctgggagggagactcagccttcctcctcatcctccctgaccctgctcctagcaccctggagagtgcacatgccccttggtcctggcagggcgccaagtctggcaccatgttggcctcttcaggcctgctagtcactggaaattgaggtccatgggggaaatcaaggatgctcagtttaaggtacactgtttccatgttatgtttctacacattgctacctcagtgctcctggaaacttagcttttgatgtctccaagtagtccaccttcatttaactctttgaaactgtatcatctttgccaagtaagagtggtggcctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgcaagaatgaaatgaatgattctacagctaggacttaaccttgaaatggaaagtcatgcaatcccatttgcaggatctgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcaatttttttttcaaagtaaaaaaaaaa

SEQ ID NO: 138 - DNA, 5217 bp, Homo sapiens
ctcggggccacggtccccccgcagcgctagtcccgggcccgcgagcaccggcccccgccacccgcaggttgcggagggaggagggcgggagcgggcggcgcggagccgggaggcgggggaggggccggcgtccgaggcggcggcggcggcggctggagcagcctctggcagcagcggggagaatgggagtgcggggcgccagaccgccgcggggtgtcacggccgccacgaagcctgcgaggcgcggggccggcgcccgcggcttttaaacccgggaaggcgcggcggcggcggcggcggcgggcagatcgcggcgcgcaccaggcgccggggcggcggccgaatggagagaaagggctcggcggccggggccaaggggaacccgagcccgcccgcggccggagaggggcagcggccaccgccgccgctgtgcgtcccgggcggcggcggaggagccccagcgaggggccaggtcggggcggcggccgagccggccgagctcatccgacgagcgcacgagttcaaaagccaaggggcgcagtgctacaaggacaagaaattccgtgaagccataggcaaataccaccgggcgttgctggagctgaaggggctgctgccgccccccggggaacgggagcgggactcgcgcccggcctccccggctggggccctgaagcccggccgcctctcggaggagcagagcaagacggtggaagccatcgagatcgactgttacaacagcctggcagcctgcctgctccaggctgagctggtaaactatgaacgagtcaaggaatattgcctcaaagtcttgaagaaggaaggggagaacttcaaggccctttaccggtctggtgtggccttctaccaccttggggactatgacaaagcactctactacctgaaagaagcaaggacccaacaaccaacagacaccaacgtgattcggtatatccagctgacggagatgaaactcagccgatgctcccagagagaaaaagaagccatgtaaccaggaagcagctccagagctgcgcccacgcctgaccggggacttccaggcatcccctggcagagagccccgtcctggattctgtccctttctccccacttcttctggctcctcatttttcctcctgttgcaccccagctctttgtctcctcccagtacgaaaaggagagatgcaaatttggaatctggtaggtcgcccagacaatggagacatcctctcctctagcaggtcagcgactgagaggggcctgacttctgctgggacagctggagaggagtctcatgggctgggatgctgttgtggctttgactttggccagtgcttctgacagaggcggagcctggcaagtgtaccatcccacaggcagcaggcacacagcccatgggctggatccttccacactttcctgacagaccagaaccagagcatctcgaggcaactgttagaaatccagggacgagacaaacagagaagcgctggtgaagccaacatagagactgtcaatgtgtacactggagttcccacccccaccccccacccgtcacttagcccctgcctccttcccccactcgttgtcttggcttgtgctttctcctctccccatcggggatccgagactctgccaggattcacatgccactgaagcccactcagtgccctctggtgaccacacataccattcccccggactcccacccagcaggcagctgtgaccgcagaagggcaggatgaagtgggccaaggtttgggacaggttgactgtgtaggtgacagggagggaaagatgatggccaggggaaagagcatcgtataggctaggggattgaactgtggactgattcagtgtaaataaaaacaaattaacaggtagtagttcctgtcagttctgttggaagcagcccactccctcacttttactccttcctccaaccctcaatcagagctacttacagccaggcaggatggggctttccccaaagcaattggccgtttgtccagtggcagacaatggtggctacagcctttgtgcttttaagagtgggctgggattgtggagactgcccaggggcttggctttgtcagaacttgtacaatcttcttttgatgaaattatctgaactcaacatctagcacatagaatgtgttcaacaaatgcttgttgaatgaataaattatgactgcagactggctctcctgccttaaactaatttcatcccagcctagtctcctgatgtctgtgctcgttatgctatgccatgttgcttcagtcaaacaagaaacacttactgagggcatattgtttgcccatcattgtgcaatatgctgtgggacatgggatgtcgtctcagtcttcaaggaaatggaagggttaagaaatgcatatgagattattaccaatgacaccgttaatttatatgatgctttaaaattatcagagcactttcatgtatttttcgtgtgactagtgaaaaagacaatgttgtacaaaattaaaatatatacagatgcaataatgtgaatagttaggatttattaaatgcattatcttcagatctttacatgtataatctcatttctttcatgcagttactctgggatactgttcccatttgatgggtaagaatattgaaaaccagaaaaattaattatcccaaggttgcatggcctttagtggcatagctaggatttgaaccaggcctgcctgactccagagctctggctagtatctatgctatacttagttgcctctctgtaagtataatattgggcaattataaccatttgagaacaggacaatatgtattaacctgaaaagtgttcatgatgtcagtgatagtacatggcctccttatgtatttactcaagggccccaaaagaccagaggccagaatccctagtagtcagagcagtgacaggtcagaaaaaggcagctgaggtccaatagttatgtctgtgtattgctcattctacttactgatggagccagcatgtatctcaacaactcacctagcattcatcacccatccccagcattgggaaagggtcacaattaagaccgaaaggaaacacaaagttaaatatgggttaattatgtaagcagatgccccaccacggcaggatccaatcacagccgaggggcccagaagagagcagcgtaagttatattcacatagttccccaaaggctttcaacgggggctacaggaaggtgctagaaatattgaggggcctgccattactcacctagagctcactctctggagaagaggaaaaggaagaagctatttcagctgccacattctccccaatccctactatattatgctgtctttcctcttcctcctagctggctttacatgaccctaacccaaaactaccctatggccccacacgggaatgtgttcaaacgccccgacccccacccccacccccattcccaagcctccaacttagaacgtttgtgatttggcagatggtttgttaggatctgaaggatgaagagaagggtagaggtcacctggagaatgagttcaaactgccagggtcttcccttggtctttgtgcgtcaggaaggactccgagtaattattccctatgcagagacaggagagaggtcttgtttacatgagtgtgctggggcagggctggacaatccaggatatgattgtagccatcccatgtagaaagatcaaaaaccagaacgaaatgaagacagcctctcagaacctcatagaacaagcgtccaggtcatctgcttgtttggtgacttagatatacaggcttactggaactccattcactgtgacctgaagttaaataatcccaaagagaaaaagctacctggggtattggttgatgtttggggtgatagggctgaattttctgtgcatttgtccaacaaaggctttagagcacaaaaccaggttcattctccctaccaaatcttcagcttccttctcctcatccctccccaaaacaagaactgtgatttaattccgtacgttgcggatgtcactgctgacctatgtagctggagtactaatcaggcatctgacctgcactgtcatcccctgcctggacttttgcgatggactctttgggggaaaaactaacgctttttaattattgtgaaagcatcatgtgtgtattgtagaagttttaggaaaaaaaggacaaaatccaatccataagcttaccacccaagacaaacgtgtattcttttgaatataccttttagttctttttggtgtaaatgtacacacgcacacacagttgtggatttttttaaacaaaaactggatacactgaatatactctttaataacttttcaagtgtgtatttatattttagaatatgtaatcctacacagatacaaaattcaaaaagtacaaactgctctgtagtcagaagtaaatcttctccctaccccgtctgccagcatctagtttccctctaatttattttgcatcctagtggagatgcttacacattgtcaaacatatgtatatattcttttatcacacacaaatggcagcatattggacactttttgttttttgctccttctgttccttcacttaataatatcacgaacattttcggcatatcaaactttctcaacagcatcttcattgtatggatggaccctttttttatcatcaatcctcaaatagtgattatttcatttgttcccaatcttcattgtaaatagtgttgcaactgacattcttgtagctaaattttgcacatgtctataacgatttccttaggataaactccaagaagagacttgcttggctatttttaagaattttgatacatgttgccaaccaccctccagaaagtttgtaccaaaacgctctcctatttggatcctagagagtaccctgtttcctgcaccctaacactaggtatcatcacttatcaaatctttcccaatttggtagctgggataatagtatgtcaatgttattttaactttctttgattcttcgcgaataacattttcatatgcttattgaccatttgtacttctttctttgtgaattttctatttatttgatattggtatgtttattatcaatttgtaattttattaagaatattatttttgtcaagaaatgctgcaaatatgctttccaagtgctttgctttcaaattttgtttatggtgctttttgacatacataaattcttaattctgc

SEQ ID NO: 139 - DNA, 3969 bp, Homo sapiens
agaccctcacgtgatgacaacagctagcaaagttctgtagctactgccttagggcatagtctaatttcttcagtaaaaacacacttattccaaatttggttccagaattgccttaaattgtttttgctctgttcttaggttgggggcggctatgagcaggcagaggatgtggtgtcacccaattaggagctctcagcttacgaggcaattagcataggttgccagggctgcacgaggagtggatttctgctttgtcattctgactctggcagttagcccgcccgctcggcgcagggcgtggcttctcgtagccattaggaaacagcaaccctttcacctcagttttcttcactccggcatttgcagcagagcgaaaggtggtcgagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataatatccacgtgtgccttcttactgaaaaaaaaaaa

SEQ ID NO: 140 - DNA, 3330 bp, Homo sapiens
cttttcttttctccaggaagagagctgtgaccagcagcgtcccttattcgcttggccttggttcctgtttgcactggctacagcagggcactggcccctactgtcaccgccacctacacaaagaccctatctctgagcgctgcagcctactgttcagccccaggtttgaggatggatgccctggacgcttcgaagctactggatgaggagctgtattcaagacagctgtatgtgctgggctcacctgccatgcagaggattcagggagccagggtcctggtgtcaggcctgcagggcctgggggccgaggtggccaagaacttggttctgatgggtgtgggcagcctcactctgcatgatccccaccccacctgctggtccgacctggctgcccagtttctcctctcagagcaggacttggaaaggagcagagccgaggcctctcaagagctcttggctcagctcaacagagctgtccaggtcgtcgtgcacacgggtgacatcactgaggacctgctgttggacttccaggtggtggtgctgactgctgcaaagctggaggagcagctgaaggtgggcaccttgtgtcataagcatggagtttgctttctggcggctgacacccggggcctcgtggggcagttgttctgtgactttggtgaggacttcactgtgcaggaccccacagaggcagaacccctgacagctgccatccagcacatctcccagggctcccctggcattctcactctgaggaaaggggccaatacccactacttccgtgatggagacttggtgactttctcgggaattgagggaatggttgagctcaacgactgtgatccccggtctatccacgtgcgggaggatgggtccctggagattggagacacaacaactttctctcggtacttgcgtggtggggctatcactgaagtcaagagacccaagactgtgagacataagtccctggacacagccctgctccagccccatgtggtggcccagagctcccaggaagttcaccatgcccactgcctgcatcaggccttctgtgcactgcacaagttccagcacctccatggccggccaccccagccctgggatcctgttgatgcagagactgtggtgggcctggcccgggacctggaaccactgaagcggacagaggaagagccactggaagagccactggatgaggccctagtgcggacagtcgccctaagcagtgcaggtgtcttgagccctatggtggccatgctgggtgcagtagctgcccaggaagtgctgaaggcaatctccaggaagttcatgcctctggaccagtggctttactttgatgccctcgattgtcttccggaagatggggagctccttcccagtcctgaggactgtgccctgagaggcagccgctatgatgggcaaattgcagtgtttggggctggttttcaggagaaactgagacgccagcactacctcctggtgggcgctggtgccattggttgtgagctgctcaaagtctttgccctagtgggactgggggccgggaacagcgggggcttgactgttgttgacatggaccacatagagcgctccaatctcagccgtcagttcctcttcaggtcccaggacgttggtagacccaaggcagaggtggctgcagcagctgcccggggcctgaacccagacttacaggtgatcccgctcacctacccactggatcccaccacagagcacatctatggggataactttttctcccgtgtggatggtgtggctgctgccctggacagtttccaggcccggcgctatgtggctgctcgttgcacccactatctgaagccactgctggaggcaggcacatcgggcacctggggcagtgctacagtattcatgccacatgtgactgaggcctacagagcccctgcctcagctgcagcttctgaggatgccccctaccctgtctgtaccgtgcggtacttccctagcacagccgagcacaccctgcagtgggcccggcatgagtttgaagaactcttccgactgtctgcagagaccatcaaccaccaccaacaggcacacacttccctggcagacatggatgagccacagacactcaccttactgaagccagtgcttggggtcctgagagtgcgtccacagaactggcaagactgtgtggcgtgggctcttggccactggaaactctgctttcattatggcatcaaacagctgctgaggcacttcccacctaataaagtgcttgaggatggaactcccttctggtcaggtcccaaacagtgtccccagcccttggagtttgacaccaaccaagacacacacctcctctacgtactggcagctgccaacctgtatgcccagatgcatgggctgcctggctcacaggactggactgcactcagggagctgctgaagctgctgccacagcctgacccccaacagatggcccccatctttgctagtaatctagagctggcttcggcttctgctgagtttggccctgagcagcagaaggaactgaacaaagccctggaagtctggagtgtgggccctcccctgaagcctctgatgtttgagaaggatgatgacagcaacttccatgtggactttgtggtagcggcagctagcctgagatgtcagaactacgggattccaccggtcaaccgtgcccagagcaagcgaattgtgggccagattatcccagccattgccaccactacagcagctgtggcaggcctgttgggcctggagctgtataaggtggtgagtgggccacggcctcgtagtgcctttcgccacagctacctacatctggctgaaaactacctcatccgctatatgccttttgccccagccatccagacgttccatcacctgaagtggacctcttgggaccgtctgaaggtaccagctgggcagcctgagaggaccctggagtcgctgctggctcatcttcaggagcagcacgggttgagggtgaggatcctgctgcacggctcagccctgctctatgcggccggatggtcacctgaaaagcaggcccagcacctgcccctcagggtgacagaactggttcagcagctgacaggccaggcacctgctcctgggcagcgggtgttggtgctagagctgagctgtgagggtgacgacgaggacactgccttcccacctctgcactatgagctgtgacaaggcagccaccctgtcacctagctcaatggagccccggatcccaagccctgcattgtaagcccacagtaggcactcaataaatgcttgttaaaggaaggcaaaaaaaaaaaaaaaaaa

SEQ ID NO: 141 - DNA, 2225 bp, Homo sapiens
agtgacgtctttgccccgcgccgcgccgtcccacccatctccctggcctccggtcccaacttcgcttctctgctgaccctctctcgtcgccgctgccgccgccgcagctgccaaaatgtctacaggtccaactgctgccactggcagtaatcgaagacttcagcagacacaaaatcaagtagatgaggtggtggacataatgcgagttaacgtggacaaggttctggaaagagaccagaagctctctgagttagacgaccgtgcagacgcactgcaggcaggcgcttctcaatttgaaacgagcgcagccaagttgaagaggaaatattggtggaagaattgcaagatgtgggcaatcgggattactgttctggttatcttcatcatcatcatcatcgtgtgggttgtctcttcatgaagaaccagcggaactcaaaactgctgttcaagaaacctcttcaagacttttgacttagaacctgctatattatcaagcttacctactgttatctctaaaattttttttgtgttaatgtaaagttgaatttctaggaaacgtgcctttgttttttaatatgcactccaaattagaaggccggccccgtccacattttgcacagtgcctttacagatttacgtatgggctgatgaagaggccttcttaagttccagagtgctataatctagatgtaatgttgtcactaattaattgccattactcccagttagttacccttgtcatttggcattattttcagaaccacattttaaacctttgggtaatcagatttccaacttatgccttccagaaaaaaacactactgcctaacacaaatctgtgataacaacaggctgtgccttattttgataattttctgattccctagaagagaaccctctactttttgtaagcactactgactctcgctgtatttaagatgctggtgaagagcttttgctcttgcattagatttgaagatgtttacattgttgttattgttatgtatcacttgctaaaaatattgttttaatcagagataacctctttaaaaaaatttttaaagaactatggctatgaccaaagcttctattttgccaaaaagttaaataccgataaaatggccttaagtgtattcctgacagttaaattcagaaacgtgccaaatggaactcaaggtgccccttcagaattaaaatcattaccttgtgtgtgaaccttctacatcttcataggcctttcttccttttgaaaggctgtagacagtgtggctccccttctgattcagtattttgcatgggggttagagaaggtttgaggtagactctgaccgtctcataaaagagttctacccagcagttggcagattatcagctgtggactccagcatgtttctgataattatgcaagcaacaattctgtagcctcaagtaagaccacctgtgaacttgatcattatctggcccaaatatgaagataaactataactttggagtttgtttcctatttgtattcacattctgcttcctaaatcagttttctaaattatgcctgcaattaggcattggtcaggggtgaatggctcttttcacagagagtagccaaccagagacctttgctttgatatcatcaactgcagagaatgctgttgatgggaatgctggaagcagaaactttgtcatcggaaaaacttttcttgtatgcatgagactcaacatcaggatccacagcttaaagatgggaattcaggtatgaaagaaaacaggcaaggaggcactgagggagaaagacacagactttatcgctctgtggctcattgttactggaatattctaaaactcttgttcacatgctattatgacttataaagcagcaacagctgaggcgcaccaggacacagcttccatttctttaacgtctgttcccttaacatcgctgaaatgatttactgttgaagagatgccttgcggtgtggccagctgtgaggagaaagcagctggcagtgttaggacattagtccaccttcagcgcagggtctctggccgggtctgactcagaaaccttggtactcgccccttggccacagtgcccagacccatgtaacccactggctcctgcattaacccagaaatacctcgcttctatctgtgcacttagctgggaacttacccactgtaatcacctaaataaagtgtttataaacatgaaaaaaaaaaaaaaaaaaaaa

SEQ ID NO: 142 - DNA, 4776 bp, Homo sapiens
cggccgcatccttgccgcccgccccggcccagccgcgtcccggagccgtcgggcatggagccgtggaagcagtgcgcgcagtggctcatccattgcaaggtgctgcccaccaaccaccgggtgacctgggactcggctcaggtgttcgaccttgcgcagaccctccgcgatggagtcctgctctgccagctgcttaacaacctccgggcgcactccatcaacctgaaggagatcaacctgaggccgcagatgtcccagtttctctgtttgaagaacataaggacatttctcacggcctgttgtgagacgtttggaatgaggaaaagtgaacttttcgaggcatttgacttgtttgatgttcgtgactttggaaaggttatagaaacattatcacgactttctcgaacacctatagcattggccacaggaatcaggcccttcccaacagaagaaagcattaatgatgaagacatctacaaaggccttcctgatttaatagatgaaacccttgtggaagatgaagaagatctctatgactgtgtttatggggaagatgaaggtggagaagtctatgaggacttaatgaaggcagaggaagcacatcagcccaaatgtccagaaaatgatatacgaagttgttgtctagcagaaattaagcagacagaagaaaaatatacagaaactttggagtcaatagaaaagtatttcatggcaccactaaaaagatttctgacagcagcagaatttgattcagtattcatcaacattcctgaacttgtaaaacttcatcggaacctaatgcaagagattcatgattccattgtaaataaaaatgaccagaacttgtaccaagtttttattaactacaaggaaagattggttatttacgggcagtactgcagtggagtggagtcagccatctctagtttagactacatttctaagacaaaagaagatgtcaaactgaaattagaggaatgttccaaaagagcaaataatgggaaatttactcttcgagacttgcttgtggttcctatgcaacgtgttttaaagtaccaccttctcctccaggaactggtcaaacataccactgatccgactgagaaggcaaatctgaaactggctcttgatgccatgaaggacttggcacaatatgtgaatgaagtgaaaagagataatgagacccttcgtgaaattaaacagtttcagctatctatagagaatttgaaccaaccagttttgctttttggacgacctcagggagatggtgaaattcgaataaccactctagacaagcataccaaacaagaaaggcatatcttcttatttgatttggcagtgatcgtatgtaagagaaaaggtgataactatgaaatgaaggaaataatagatcttcagcagtacaagatagccaataatcctacaaccgataaagaaaacaaaaagtggtcttatggcttctacctcatccatacccaaggacaaaatgggttagaattttattgcaaaacaaaagatttaaagaagaaatggctagaacagtttgaaatggctttgtctaacataagaccagactatgcagactccaatttccacgacttcaagatgcataccttcactcgagtcacatcctgcaaagtctgccagatgctcctgaggggaacattttatcaaggctatttatgttttaagtgtggagcgagagcacacaaagaatgtttgggaagagtagacaattgtggcagagttaattctggtgaacaagggacactcaaactaccagagaaacggaccaatggactgcgaagaactcctaaacaggtggatccaggtttaccaaagatgcaggtcattaggaactattctggaacaccacccccagctctgcatgaaggaccccctttacagctccaggccggggataccgttgaacttctgaaaggagatgcacacagtctgttttggcagggcagaaatttagcatctggagaggttggattttttccaagtgatgcagtcaagccttgcccatgtgtgcccaaaccagtagattattcttgccaaccctggtatgctggagcaatggaaagattgcaagcagagaccgaacttattaatagggtaaatagtacttaccttgtgaggcacaggaccaaagagtcaggagaatatgcaattagcattaagtacaataatgaagcaaagcacatcaagattttaacaagagatggcttttttcacattgcagaaaatagaaaatttaaaagtttaatggaacttgtggagtactacaagcatcattctctcaaggaagggttcagaaccttagatacaactctgcagtttccatacaaggagccagaacattcagctggacagaggggtaatagagcaggcaacagcttgttaagtccaaaagtgctgggcattgccatcgctcggtatgacttctgtgcaagagatatgagagagttgtccttgttgaaaggagatgtggtgaagatttacacaaagatgagtgcaaatggctggtggagaggagaagtaaatggcagggtgggctggtttccatccacatatgtggaagaggatgaataaattcaaatcccgtgttgcaccctgcaccaaaaatttcagagaagggataaatagaagcctgcacagcatcgtgaattaactgaagtgtttaaaaagctgcatttctggctgttcaacatcctccctccttagcccctcctaagtcttaatgctgagatttctaaagatgctggtactgacagattaatggcttgcctagagctgtgcaagaaacagcctgccagtctgtcattgtcagggaccagggcaaaaccaagagctgttcttcccagaagagccctgcaaacacattggttcgtgcttccctttacttcttctggtcagataccatgaatgccagtcatcagtaaatcttaatacacttttgctttattctcacatgccattcaccagattatttgatggtacaaagaagcagaagtgtaattttccttttcccagcatgacgaaaaattggagttctgccatttgagcagcttactggaaagatccagccttacttgtcttaaattgtccaacaaggtgactcattgcccggcaaacacttttaccctcagatgttactcatgatattataaaatatgaggccagtgctcaggtttgcatcataagtgagctatccctgaagggttttaattacttatttggtgtcctgattatatttgcaaacttctttataaaaggtgaaaaaagcacacaaaagagagggtgtcttcatattaaaccttcacaaccttcatgatttcataggattattttggaaatatagcacttgactttatgaaaggatctgggctaggtatattaagggtagttgccaataacctgaagaagctggcattgtttacagaaacagatcaagggctataatttatgtcattttatagcagcagtatctattaatacatgccttttcctcccatccacctcccccgcacacacacaaagatgacctgggacatgatttttttattcccacattttcttggagcacaaacaactttgttgaggattttggaaggaaagcacaactgggtcctttattcatttctgggacagaaagagggtcagtggacttttgtgggcctccagcttctctcagagtctccccctctgcagcccatcctgggagtgtattaactggagggaagatgggtcttgcagtacatttgttttgcccagccatcactcttttttgtgaggagcctaaatacattcttcctggggtccagagtccccattcaaggcagtcaagttaagacactaacttggccctttcctgatggaaatatttcctccatagcagaagttgtgttctgacaagactgagagagttacatgttgggaaaaaaaagaagcattaacttagtagaactgaaccaggagcattaagttctgaaattttgaatcatctctgaaatgaagcaggtgtagcctgccctctcatcaatccgtctgggtgccagaactcaaggttcagtggacacatccccctgttagagaccctcatgggctaggacttttcatctaggatagattcaagacctttacctcagaattatgtaaactgtgattgtgttttagaaaaattattatttgctaaaaccatttaagtctttgtatatgtgtaaatgatcacaaaaatgtattttataaaatgttctgtacaataaagttacacctcaaagtgtactcttggaatggattctttcctgtaaagtcttatctgcgactctgtctcgggaatgttttgtctgttgccgtcagccgaactttgttatggagggagcagcctcacacaagcagaaacactcctgtggatggtattgtagcatgtattgtttattttagtcaatagaccctctccttataaatggtgtttagtcttcctgttgcatttcatgggcctgggggtttcctagcagaggatattggagcccctttttgtgacattaccaattacatctttgtccacgtttaatactttgttttggaaaatttaaatgctgcagatttgtgtagagttctaataccaaagacagaagtaaatgttttccatatactttgtcttgcctgtatgcagccctcgtgtaatacggtgaattagagtggtatttcactttgtattattttgtaaatatgtcaatataataaatagtgactaaattgataaaaaaa

SEQ ID NO: 143 - DNA, 2103 bp, Homo sapiens
acttcggggaaggggagggaggagggggacgagggctctggcgggtttggaggggctgaacatcgcggggtgttctggtgtcccccgccccgcctctccaaaaagctacaccgacgcggaccgcggcggcgtcctccctcgccctcgcttcacctcgcgggctccgaatgcggggagctcggatgtccggtttcctgtgaggcttttacctgacacccgccgcctttccccggcactggctgggagggcgccctgcaaagttgggaacgcggagccccggacccgctcccgccgcctccggctcgcccagggggggtcgccgggaggagcccgggggagagggaccaggaggggcccgcggcctcgcaggggcgcccgcgcccccacccctgcccccgccagcggaccggtcccccacccccggtccttccaccatgcacttgctgggcttcttctctgtggcgtgttctctgctcgccgctgcgctgctcccgggtcctcgcgaggcgcccgccgccgccgccgccttcgagtccggactcgacctctcggacgcggagcccgacgcgggcgaggccacggcttatgcaagcaaagatctggaggagcagttacggtctgtgtccagtgtagatgaactcatgactgtactctacccagaatattggaaaatgtacaagtgtcagctaaggaaaggaggctggcaacataacagagaacaggccaacctcaactcaaggacagaagagactataaaatttgctgcagcacattataatacagagatcttgaaaagtattgataatgagtggagaaagactcaatgcatgccacgggaggtgtgtatagatgtggggaaggagtttggagtcgcgacaaacaccttctttaaacctccatgtgtgtccgtctacagatgtgggggttgctgcaatagtgaggggctgcagtgcatgaacaccagcacgagctacctcagcaagacgttatttgaaattacagtgcctctctctcaaggccccaaaccagtaacaatcagttttgccaatcacacttcctgccgatgcatgtctaaactggatgtttacagacaagttcattccattattagacgttccctgccagcaacactaccacagtgtcaggcagcgaacaagacctgccccaccaattacatgtggaataatcacatctgcagatgcctggctcaggaagattttatgttttcctcggatgctggagatgactcaacagatggattccatgacatctgtggaccaaacaaggagctggatgaagagacctgtcagtgtgtctgcagagcggggcttcggcctgccagctgtggaccccacaaagaactagacagaaactcatgccagtgtgtctgtaaaaacaaactcttccccagccaatgtggggccaaccgagaatttgatgaaaacacatgccagtgtgtatgtaaaagaacctgccccagaaatcaacccctaaatcctggaaaatgtgcctgtgaatgtacagaaagtccacagaaatgcttgttaaaaggaaagaagttccaccaccaaacatgcagctgttacagacggccatgtacgaaccgccagaaggcttgtgagccaggattttcatatagtgaagaagtgtgtcgttgtgtcccttcatattggaaaagaccacaaatgagctaagattgtactgttttccagttcatcgattttctattatggaaaactgtgttgccacagtagaactgtctgtgaacagagagacccttgtgggtccatgctaacaaagacaaaagtctgtctttcctgaaccatgtggataactttacagaaatggactggagctcatctgcaaaaggcctcttgtaaagactggttttctgccaatgaccaaacagccaagattttcctcttgtgatttctttaaaagaatgactatataatttatttccactaaaaatattgtttctgcattcatttttatagcaacaacaattggtaaaactcactgtgatcaatatttttatatcatgcaaaatatgtttaaaataaaatgaaaattgtattataagctgaaaaaaaaaaaaaaaaa

SEQ ID NO: 144 - DNA, 4012 bp, Homo sapiens
gtgggagcccgcgaggtggcccgagcgagggccccgcatccccgcagagcccgcccgagggcgcagcctgccacgccaggggaggcggccgggcggcggggaacggcgggggcggagcgcagcctcccgacgccgccgcctcaccgcccccctccgcctcctcggcctccgctcgcagccgccgcctccgcctccgccgggctgaggagccgggagtccgccgcgccggctcggggctgcgggatggggagttagcgccacggcggcggcagtggccgcagcgcaccccgccgccgcccaggagcccgtccagccaggggtgccgggcccgcccagcccgccccggagccaggcccgcgggcggcggcggagctgggcaggtggatgcggctggaagatggcgccctcgggcccgggcagcagcgccaggcggcggtgccggcgggtgctgtactggatcccggtggtgttcatcaccctcctgctcggctggtcctactacgcctacgccatccagctgtgcatagtgtccatggaaaacactggcgaacaagttgtgtgcctgatggcctatcatctactttttgcaatgtttgtctggtcatactggaaaactatctttacattaccaatgaatccttcaaaagaattccatctctcttatgcagagaaagatttgttggagagagagccaagaggagaagcccatcaggaagttcttaggcgagcagccaaggatcttcccatctataccaggaccatgtctggagccatccgatactgtgacagatgccaacttataaaaccagatcgctgccatcactgctccgtctgtgataaatgtattttgaagatggatcatcattgtccatgggtgaacaattgtgttggattttcaaattataagttctttctccttttcttggcttattctctgctctactgcctttttattgcggcaacagatttacagtattttatcaaattttggacaaatggcctacctgatactcaagccaagttccatattatgtttttattctttgctgcagctatgttttctgtcagcttgtcttctctgtttggctatcattgttggctagtcagcaaaaataaatctacattagaggcattcagaagtccagtatttcgacatggaacagataagaatggattcagcttgggtttcagtaaaaacatgcgacaagtttttggtgatgagaagaagtactggttgctacccattttttcaagtctaggtgatggctgctcctttccaacttgccttgttaaccaggatcctgaacaagcatctactcctgcagggctgaattccacagctaaaaatctcgaaaaccatcagtttcctgcaaagccattgagagagtcccagagccaccttcttactgattctcagtcttggacggagagcagcataaacccaggaaaatgcaaagctggtatgagcaatcctgcattaaccatggaaaatgagacttaactcttcaagcaagataaattcatactttataaaagtatcaatgctgtagatggatggaagaggcttcccacaggaaggtgccaccagtcagttgtgcctatgtccctttggctggaaatgcagaatatgaattgattagttctctccaagccattgcttaaaatataacatgttttggatccaatacacacattgttacaactaacacaaattcctattaaatattaaaagtagttctggtttattaatcaacggggaaaacatcttctccaaaaaacttggaataaatccaaggaccagtttttacccaaatatatgggtagcacagtttatcacatagaaactccattaatcatctgattttccgaatctgaaaattgagactattaagatattaggatttcagagatttcaagtcacattataatgataagcattattcataaaacttgttacctttaagaaggtggaagtggcaaaccatacttcttttttttcctctgatgtgaatccagcctcagactgagtgaactgtaataattatgaattcattacagagtccaggtggcctgcagttgaagatcatcaaccatttttgcctcacttaattccagccttttgttttctgctggaaaataagtgtggacattgaagcttgagctctcaaagcagttggctggaatacttttgtcagaatacggtacatttctattacatcagaaatatattttcatctcttcttgttaaattgggaggaaatttatgatagcaattatgaagattgttttatgacattcttttgtcagtttggctttctaaaaatctctttttagattatttctcctgttgaacatagtaaaactattgaatttctcttaagaattcctaataggtcaatagatttaccctccagtgatatctatattatttctttctcgtctcatcaaaatgatgacaggtaaactatatttttccttaaacacctattacagttaaattatgcaaatcattaaataaaaatcatacaacttttggaaagttagttcaacatgaactaaaatggcatgctatttggaaatttagtttgagataaactaaagtgtgttgatgccagaatgttcagcttcagtaaatataataagctcttgtgccttgtatgcactatttaaaaaaagttttttttatttgagtccagtataattcatgtaaatgttaacaattagaataatactctgtatgcttttttgatactgattttgagaatttaaagcagattaccttttaaaactggaccaactaagtaattggtatttaatcaaagagaaaatggtaataaacttttcaaaatctttgttaaaccaaacattcaacacaaaataaactagaaggccagaggataatggaataaaagatcattgcaattacttatccttcctaaaaatatagttttatattaattgtgcttatggaagaaacaatgtcagccaagtccattttatagtttgagtgcaattctttgaacaatagaaatatctgcagtctttcacagatttgtattatgctgaagagtttcatctgacaatctgcttcaagaaatctcagaaaatatgataacattttaactttcattttagagcacgttttggtcatttttaaaaatacctaaagtgccagaccggaacctatagctactgctagaagtcttaaaaaaaccaacagcagcacaggatgtattaagaattatatgaagtcaggtttgtttttttttttttttttttttcaaagcacagtactgttagctgtttttgtggacaggattcgattaagtattccctcttgtcaaactggaagctaggggaaaaagagggatttttatcctttactcttctagagtactgttaatgcccctttcccacagtcttttatataattaaatatatgtcaatacacattagaatcagatttgaaaaagttaaaacaatttcattgttgtaattgttccctttctgttttcatatagtgaataacctttaaagggttgttttgttttgttttgaattataggagttataatctttggagatgattgcatatctcattagatatgcaatataaatttatctgagtgaacaaagtgctaaataaatagatctacattttgtacatatttatataaaatttacctttaagtatttactttaaaaaatttaatggcttaactcgaacttgaagacacatacttcaactgtccttattgtccattaaactgataattttgatttttcttgcttttatagattttactatataggaatcaagatttaagaaattttgcattaaaaatagtgtaccaatgcttcatatacgttagttatttgctattatgtagggaagaggattgttatttcaaagatatattaaagaacagttgcatctgaatataatcatgatgcattcaatgaagttcatatccatgaattcactcctaatataccctaataaagtggttga

What is claimed is:

1. A method of detecting a group of biomarkers in a head and neck tissue sample obtained from a patient, the method comprising measuring the nucleic acid expression level of every biomarker in the group of biomarkers consisting of only ATP binding cassette subfamily C member 1 (ABCC1), ATP binding cassette subfamily C member 5 (ABCC5), actinin alpha 1 (ACTN1), amyloid beta precursor protein binding family B member 2 (APBB2), apolipoprotein L3 (APOL3), aquaporin 3 (AQP3), ATPase 13A4 (ATP13A4), ATPase H+ transporting V1 subunit D (ATP6V1D), calcium binding tyrosine phosphorylation regulated (CABYR), caspase 4 (CASP4), caveolin 1 (CAV1), corneodesmosin (CDSN), choline phosphotransferase 1 (CHPT1), carbohydrate sulfotransferase 7 (CHST7), class II major histocompatibility complex transactivator (CIITA), CKLF like MARVEL transmembrane domain containing 3 (CMTM3), collagen type VI alpha 1 chain (COL6A1), collagen type VI alpha 2 chain (COL6A2), cystatin A (CSTA), Cytochrome P450 family 26 subfamily A member 1 (CYP26A1), dehydrogenase/reductase 1 (DHRS1), E74 like ETS transcription factor 3 (ELF3), epithelial cell adhesion molecule (EPCAM), epithelial mitogen (EPGN), family with sequence similarity 171 member A1 (FAM171A1), family with sequence similarity 3 member B (FAM3B), striatin interacting protein 1 (FAM40A), filamin binding LIM protein 1 (FBLIM1), forkhead box A1 (FOXA1), follistatin like 3 (FSTL3), fucosyltransferase 6 (FUT6), glucosaminyl (N-acetyl) transferase 2, I-branching enzyme (I blood group) (GCNT2), glutathione peroxidase 8 (putative) (GPX8), grainyhead like transcription factor 3 (GRHL3), gasdermin A (GSDMA), HLF, PAR bZIP transcription factor (HLF), interleukin 4 receptor (IL4R), inhibin beta A subunit (INHBA), KIAA1609, Kruppel like factor 5 (KLF5), prolyl 3-hydroxylase 1 (LEPRE1), latent transforming growth factor beta binding protein 3 (LTBP3), mal, T-cell differentiation protein 2 (MAL2), MAP7 domain containing 1 (MAP7D1), Meis homeobox 1 (MEIS1), MOB kinase activator 3B (MOBKL2B), mucin 4, cell surface associated (MUC4), nicotinamide N-methyltransferase (NNMT), NOP2/Sun RNA methyltransferase family member 7 (NSUN7), olfactomedin like 2B (OLFML2B), olfactomedin like 3 (OLFML3), prolyl 4-hydroxylase, transmembrane (P4HTM), POZ/BTB and AT hook containing zinc finger 1 (PATZ1), PBX homeobox 1 (PBX1), procollagen C-endopeptidase enhancer (PCOLCE), pleckstrin homology like domain family B member 1 (PHLDB1), placenta specific 8 (PLAC8), phospholipase D2 (PLD2), peroxisome proliferator activated receptor delta (PPARD), periplakin (PPL), protein kinase, X-linked (PRKX), RAB6B, member RAS oncogene family (RAB6B), ribosomal modification protein rimK like family member A (RIMKLA), serpin family E member 1 (SERPINE1), serpin family H member 1 (SERPINH1), sideroflexin 3 (SFXN3), SH3-containing guanine nucleotide exchange factor (SGEF), solute carrier family 31 member 2 (SLC31A2), SLC9A3 regulator 1 (SLC9A3R1), snail family transcriptional repressor 2 (SNAI2), transforming growth factor beta induced (TGFBI), tight junction protein 3 (TJP3), transmembrane protein 51 (TMEM51), transmembrane protease, serine 11A (TMPRSS11A), transmembrane protease, serine 11B (TMPRSS11B), transmembrane protease, serine 2 (TMRSS2), tetratricopeptide repeat domain 9 (TTC9), thioredoxin reductase 1 (TXNRD1), ubiquitin like modifier activating enzyme 7 (UBA7) and zinc finger DHHC-type containing 2 (ZDHHC2) in the head and neck tissue sample obtained from the patient using an amplification, a hybridization and/or a sequencing assay.

2. The method of claim 1, wherein the head and neck tissue sample was previously diagnosed as being squamous cell carcinoma.

3. The method of claim 1, wherein the amplification, hybridization and/or sequencing assay is selected from the group consisting of quantitative real time reverse transcriptase polymerase chain reaction (qRT-PCR), RNAseq, microarray analysis, Serial Analysis of Gene Expression (SAGE), Rapid Analysis of Gene Expression (RAGE), nuclease protection assays and Northern blotting.

4. The method of claim 1, wherein the head and neck tissue sample is a formalin-fixed, paraffin-embedded (FFPE) head and neck tissue sample, fresh or a frozen head and neck tissue sample, an exosome, wash fluids, cell pellets, or a bodily fluid obtained from the patient.

5. The method of claim 1, wherein the method further comprises an additional step of measuring the nucleic acid expression level of one or more HPV genes in the head and neck tissue sample obtained from the patient using an additional amplification, hybridization or sequencing assay.

6. The method of claim 5, wherein the one or more HPV genes is the E6 gene, the E7 gene, the E6 and E7 genes or the E6 and E7 genes in combination with one or more additional genes from the HPV genome.

7. A method of treating HNSCC in a patient, the method comprising:
  (a) determining the subtype of a head and neck tissue sample obtained from the patient, wherein the determining the subtype comprises:
    (i) measuring the nucleic acid expression level of every biomarker in a group of biomarkers in the head and neck tissue sample obtained from the patient, wherein the group of biomarkers consists of only ABCC1, ABCC5, ACTN1, APBB2, APOL3, AQP3, ATP13A4, ATP6V1D, CABYR, CASP4, CAV1, CDSN, CHPT1, CHST7, CIITA, CMTM3, COL6A1, COL6A2, CSTA, CYP26A1, DHRS1, ELF3, EPCAM, EPGN, FAM171A1, FAM3B, FAM40A, FBLIM1, FOXA1, FSTL3, FUT6, GCNT2, GPX8, GRHL3, GSDMA, HLF, IL4R, INHBA, KIAA1609, KLF5, LEPRE1, LTBP3, MAL2, MAP7D1, MEIS1, MOBKL2B, MUC4, NNMT, NSUN7, OLFML2B, OLFML3, P4HTM, PATZ1, PBX1, PCOLCE, PHLDB1, PLAC8, PLD2, PPARD, PPL, PRKX, RAB6B, RIMKLA, SERPINE1, SERPINH1, SFXN3, SGEF, SLC31A2, SLC9A3R1, SNAI2, TGFBI, TJP3, TMEM51, TMPRSS11A, TMPRSS11B, TMRSS2, TTC9, TXNRD1, UBA7 and ZDHHC2;
    (ii) comparing the detected nucleic acid expression levels of ABCC1, ABCC5, ACTN1, APBB2, APOL3, AQP3, ATP13A4, ATP6V1D, CABYR, CASP4, CAV1, CDSN, CHPT1, CHST7, CIITA, CMTM3, COL6A1, COL6A2, CSTA, CYP26A1, DHRS1, ELF3, EPCAM, EPGN, FAM171A1, FAM3B, FAM40A, FBLIM1, FOXA1, FSTL3, FUT6, GCNT2, GPX8, GRHL3, GSDMA, HLF, IL4R, INHBA, KIAA1609, KLF5, LEPRE1, LTBP3, MAL2, MAP7D1, MEIS1, MOBKL2B, MUC4, NNMT, NSUN7, OLFML2B, OLFML3, P4HTM, PATZ1, PBX1, PCOLCE, PHLDB1, PLAC8, PLD2, PPARD, PPL, PRKX, RAB6B, RIMKLA, SERPINE1, SERPINH1, SFXN3, SGEF, SLC31A2, SLC9A3R1, SNAI2, TGFBI, TJP3, TMEM51, TMPRSS11A, TMPRSS11B, TMRSS2, TTC9, TXNRD1, UBA7 and ZDHHC2 in the head and neck tissue sample obtained from the patient to the nucleic acid expression levels of ABCC1, ABCC5, ACTN1, APBB2, APOL3, AQP3, ATP13A4, ATP6V1D, CABYR, CASP4, CAV1, CDSN, CHPT1, CHST7, CIITA, CMTM3, COL6A1, COL6A2, CSTA, CYP26A1, DHRS1, ELF3, EPCAM, EPGN, FAM171A1, FAM3B, FAM40A, FBLIM1, FOXA1, FSTL3, FUT6, GCNT2, GPX8, GRHL3, GSDMA, HLF, IL4R, INHBA, KIAA1609, KLF5, LEPRE1, LTBP3, MAL2, MAP7D1, MEIS1, MOBKL2B, MUC4, NNMT, NSUN7, OLFML2B, OLFML3, P4HTM, PATZ1, PBX1, PCOLCE, PHLDB1, PLAC8, PLD2, PPARD, PPL, PRKX, RAB6B, RIMKLA, SERPINE1, SERPINH1, SFXN3, SGEF, SLC31A2, SLC9A3R1, SNAI2, TGFBI, TJP3, TMEM51, TMPRSS11A, TMPRSS11B, TMRSS2, TTC9, TXNRD1, UBA7 and ZDHHC2 in at least one sample training set, wherein the at least one sample training set comprises a reference HNSCC BA sample, a reference HNSCC MS sample, a reference HNSCC AT sample, a reference HNSCC CL sample or a combination thereof; and
    (iii) classifying the sample as basal (BA), mesenchymal (MS), atypical (AT) or classical (CL) based on the results of the comparing step; and
  (b) administering an immunotherapeutic agent based on the subtype of the HNSCC.

8. The method of claim 7, wherein the head and neck tissue sample is a HNSCC sample.

9. The method of claim 7, wherein the measuring the nucleic acid expression level is conducted using an amplification, hybridization and/or sequencing assay.

10. The method of claim 9, wherein the amplification, hybridization and/or sequencing assay is selected from the group consisting of quantitative real time reverse transcriptase polymerase chain reaction (qRT-PCR), RNAseq, microarray analysis, Serial Analysis of Gene Expression (SAGE), Rapid Analysis of Gene Expression (RAGE), nuclease protection assays and Northern blotting.

11. The method of claim 7, wherein the head and neck tissue sample is a formalin-fixed, paraffin-embedded (FFPE) head and neck tissue sample, fresh or a frozen head and neck tissue sample, an exosome, wash fluids, cell pellets, or a bodily fluid obtained from the patient.

12. The method of claim 7, wherein the patient's HNSCC subtype is selected from basal, mesenchymal, atypical or classical.

13. The method of claim 7, wherein the method further comprises determining the HPV status of the patient prior to step (b), wherein the determining the HPV status of the patient comprises measuring the nucleic acid expression level of one or more HPV genes in the head and neck tissue sample obtained from the patient.

14. The method of claim 13, wherein the one or more HPV genes is the E6 gene, the E7 gene, the E6 and E7 genes or the E6 and E7 genes in combination with one or more additional genes from the HPV genome.

15. The method of claim 7, wherein the comparing step comprises applying a statistical algorithm which comprises determining a correlation between the nucleic acid expression level data obtained from the sample and the nucleic acid expression level data from the at least one sample training set; and classifying the sample as a BA, MS, AT or CL subtype based on the results of the statistical algorithm.

* * * * *